US011147886B2

(12) United States Patent
Ng et al.

(10) Patent No.: US 11,147,886 B2
(45) Date of Patent: Oct. 19, 2021

(54) DRUG-CONJUGATED BI-SPECIFIC ANTIGEN-BINDING CONSTRUCTS

(71) Applicant: Zymeworks Inc., Vancouver (CA)

(72) Inventors: Gordon Yiu Kon Ng, Vancouver (CA); Leonard G. Presta, San Francisco, CA (US); Thomas Spreter Von Kreudenstein, Vancouver (CA)

(73) Assignee: Zymeworks Inc., Vancouver (CA)

( * ) Notice: Subject to any disclaimer, the term of this patent is extended or adjusted under 35 U.S.C. 154(b) by 0 days.

(21) Appl. No.: 15/741,984

(22) PCT Filed: Jul. 15, 2016

(86) PCT No.: PCT/CA2016/050839
§ 371 (c)(1),
(2) Date: Jan. 4, 2018

(87) PCT Pub. No.: WO2017/008169
PCT Pub. Date: Jan. 19, 2017

(65) Prior Publication Data
US 2018/0193477 A1    Jul. 12, 2018

Related U.S. Application Data

(60) Provisional application No. 62/193,056, filed on Jul. 15, 2015, provisional application No. 62/193,569, filed on Jul. 16, 2015.

(51) Int. Cl.
| | |
|---|---|
| *A61K 47/68* | (2017.01) |
| *C07K 16/28* | (2006.01) |
| *C07K 16/46* | (2006.01) |
| *C07K 16/32* | (2006.01) |
| *A61P 35/02* | (2006.01) |

(Continued)

(52) U.S. Cl.
CPC ...... *A61K 47/6803* (2017.08); *A61K 39/3955* (2013.01); *A61K 39/39558* (2013.01); *A61K 45/06* (2013.01); *A61K 47/6811* (2017.08); *A61K 47/6817* (2017.08); *A61K 47/6835* (2017.08); *A61K 47/6849* (2017.08); *A61K 47/6855* (2017.08); *A61K 47/6869* (2017.08); *A61K 47/6879* (2017.08); *A61K 51/103* (2013.01); *A61K 51/1027* (2013.01); *A61K 51/1042* (2013.01); *A61K 51/1051* (2013.01); *A61K 51/1072* (2013.01); *A61P 35/00* (2018.01); *A61P 35/02* (2018.01); *A61P 35/04* (2018.01); *C07K 16/28* (2013.01); *C07K 16/2803* (2013.01); *C07K 16/2809* (2013.01); *C07K 16/2863* (2013.01); *C07K 16/32* (2013.01); *C07K 16/46* (2013.01); *C40B 40/02* (2013.01); *C40B 40/08* (2013.01); *A61K 2039/505* (2013.01); *A61K 2039/572* (2013.01); *C07K 2317/21* (2013.01); *C07K 2317/24* (2013.01); *C07K 2317/31* (2013.01); *C07K 2317/33* (2013.01); *C07K 2317/52* (2013.01); *C07K 2317/524* (2013.01); *C07K 2317/526* (2013.01); *C07K 2317/53* (2013.01); *C07K 2317/55* (2013.01); *C07K 2317/56* (2013.01); *C07K 2317/565* (2013.01); *C07K 2317/622* (2013.01); *C07K 2317/71* (2013.01); *C07K 2317/73* (2013.01); *C07K 2317/75* (2013.01); *C07K 2317/76* (2013.01); *C07K 2317/77* (2013.01); *C07K 2317/92* (2013.01); *C07K 2317/94* (2013.01); *C07K 2319/00* (2013.01)

(58) Field of Classification Search
CPC ............ A61K 47/6803; A61K 47/6869; A61K 47/6817; A61K 47/6855; A61K 39/39558; A61K 45/06; A61K 51/1027; A61K 51/103; A61K 51/1042; A61K 51/1051; A61K 51/1072; A61K 47/6849; A61K 2039/572; A61K 2039/505; A61P 35/02; A61P 35/04; A61P 35/00; C07K 2317/24; C07K 2317/31; C07K 2317/52; C07K 2317/55; C07K 2317/56; C07K 2317/622; C07K 2317/71; C07K 2317/73; C07K 2317/77; C07K 2317/92; C07K 2317/94; C07K 2319/00; C07K 16/2803; C07K 16/2809; C07K 16/2863; C07K 16/28; C07K 16/46; C07K 2317/21; C07K 2317/524; C07K 2317/526; C07K 2317/53; C07K 2317/565; C07K 2317/76
See application file for complete search history.

(56) References Cited

U.S. PATENT DOCUMENTS

| | | | |
|---|---|---|---|
| 5,731,168 | A | 3/1998 | Carter et al. |
| 7,740,847 | B2 | 6/2010 | Allan et al. |

(Continued)

FOREIGN PATENT DOCUMENTS

| | | | | |
|---|---|---|---|---|
| WO | 1996026964 A1 | 9/1996 | | |
| WO | WO-2005056606 A2 * | 6/2005 | ............. | C07K 16/00 |

(Continued)

OTHER PUBLICATIONS

Rudikoff et al., Proc. Natl. Acad. Sci. USA 79: 1979-1983 (Year: 1982).*

(Continued)

*Primary Examiner* — Phuong Huynh
(74) *Attorney, Agent, or Firm* — Goodwin Procter LLP

(57) ABSTRACT

Bispecific antigen-binding constructs e.g., antibodies conjugated to drugs (ADCs), which bind CD3 and other cell-surface target antigen such as tumor antigens e.g., CD19, CDH3, HER2, HER3 and EGFR antigens and methods of use are disclosed.

15 Claims, 41 Drawing Sheets

Specification includes a Sequence Listing.

(51) Int. Cl.
| | |
|---|---|
| *A61P 35/04* | (2006.01) |
| *A61P 35/00* | (2006.01) |
| *A61K 39/395* | (2006.01) |
| *A61K 45/06* | (2006.01) |
| *A61K 51/10* | (2006.01) |
| *A61K 39/00* | (2006.01) |
| *C40B 40/08* | (2006.01) |
| *C40B 40/02* | (2006.01) |

(56) References Cited

U.S. PATENT DOCUMENTS

| | | | |
|---|---|---|---|
| 7,951,917 | B1 | 5/2011 | Arathoon et al. |
| 8,101,720 | B2 | 1/2012 | Lazar et al. |
| 8,435,749 | B2 * | 5/2013 | Togashi ............... C07K 16/28 435/7.1 |
| 8,501,185 | B2 | 8/2013 | Heitner Hansen et al. |
| 9,605,084 | B2 * | 3/2017 | Moore ................. C07K 16/22 |
| 9,650,446 | B2 * | 5/2017 | Moore ............... C07K 16/2809 |
| 2002/0009454 | A1 | 1/2002 | Boone et al. |
| 2004/0071696 | A1 | 4/2004 | Adams et al. |
| 2007/0123479 | A1 | 5/2007 | Kufer et al. |
| 2007/0196363 | A1 | 8/2007 | Arathoon et al. |
| 2008/0138336 | A1 | 6/2008 | Damschroder et al. |
| 2008/0260731 | A1 * | 10/2008 | Bernett ............ C07K 16/2803 424/133.1 |
| 2009/0226466 | A1 | 9/2009 | Fong et al. |
| 2010/0166749 | A1 | 7/2010 | Presta |
| 2010/0196265 | A1 | 8/2010 | Adams et al. |
| 2011/0275787 | A1 | 11/2011 | Kufer et al. |
| 2012/0149876 | A1 | 6/2012 | Von Kreudenstein et al. |
| 2012/0244577 | A1 | 9/2012 | Dixit et al. |
| 2012/0270801 | A1 | 10/2012 | Frejd et al. |
| 2013/0078249 | A1 | 3/2013 | Ast et al. |
| 2013/0089554 | A1 | 4/2013 | Blankenship et al. |
| 2013/0129723 | A1 | 5/2013 | Blankenship et al. |
| 2013/0195849 | A1 | 8/2013 | Spreter Von Kreudenstein et al. |
| 2014/0066378 | A1 | 3/2014 | Dixit et al. |
| 2014/0154253 | A1 * | 6/2014 | Ng ......................... A61P 29/00 424/136.1 |
| 2014/0199294 | A1 | 7/2014 | Mimoto et al. |
| 2014/0370013 | A1 | 12/2014 | Desjarlais et al. |
| 2015/0044216 | A1 * | 2/2015 | Wu ................... A61K 47/6879 424/136.1 |

FOREIGN PATENT DOCUMENTS

| | | |
|---|---|---|
| WO | 2007093630 A1 | 8/2007 |
| WO | WO-2008119567 A2 * | 10/2008 ......... C07K 16/4291 |
| WO | 2010126137 | 11/2010 |
| WO | 2011051307 A1 | 5/2011 |
| WO | 2011120134 A1 | 10/2011 |
| WO | 2011120135 A1 | 10/2011 |
| WO | 2011147982 A2 | 12/2011 |
| WO | 2012022814 A1 | 2/2012 |
| WO | 2012058768 A1 | 5/2012 |
| WO | 2012062596 A1 | 5/2012 |
| WO | 2012116453 A1 | 9/2012 |
| WO | 2012143524 A2 | 10/2012 |
| WO | 2012146394 A1 | 11/2012 |
| WO | 2013166594 A1 | 11/2013 |
| WO | 2013166604 A1 | 11/2013 |
| WO | 2013171505 A2 | 11/2013 |
| WO | 2014004586 A1 | 1/2014 |
| WO | 2014012082 A2 | 1/2014 |
| WO | 2014012085 A2 | 1/2014 |
| WO | 2014018572 A2 | 1/2014 |
| WO | 2014082179 A1 | 6/2014 |
| WO | 2014182970 A1 | 11/2014 |
| WO | WO 2015/006749 A2 | 1/2015 |
| WO | WO 2015/077891 A1 | 6/2015 |
| WO | WO 2015/109131 A2 | 7/2015 |
| WO | WO 2016/001810 A1 | 1/2016 |

OTHER PUBLICATIONS

Wu et al., J. Mol. Biol. 294: 151-162 (Year: 1999).*
Ito et al., FEBS Letters 309(1): 85-88 (Year: 1992).*
Dennis et al., Nature 442:739-741 (Year: 2006).*
Beckman et al., Cancer 109:170-179 (Year: 2007).*
Patent Cooperation Treaty, International Search Report, International Patent Application No. PCT/US2016/050839, dated Sep. 27, 2016, 8 Pages.
Patent Cooperation Treaty, Written Opinion of the International Searching Authority, International Patent Application No. PCT/US2016/050839, dated Sep. 27, 2016, 11 Pages.
Bargou, R. et al, Tumor regression in cancer patients by very low doses of a T cell-engaging antibody. Science. Aug. 2008;321 (5891):974-977.
Beckman, R.A. et al, Antibody constructs in cancer therapy: protein engineering strategies to improve exposure in solid tumors. Cancer. Jan. 2007; 109(2):170-179.
Breton, C. S., et al. A novel anti-CD19 monoclonal antibody (GBR 401) with high killing activity against B cell malignancies. J Hematol Oncol 2014; 7:33.
Buhmann, R. et al, Immunotherapy with FBTA05 (Bi20), a trifunctional bispecific anti-CD3 x anti-CD20 antibody and donor lymphocyte infusion (DLI) in relapsed or refractory B-cell lymphoma after allogeneic stem cell transplantation study protocol of an investigator-driven, open-label, non-randomized, uncontrolled, dose-escalating Phase I/II-trial. J Transl Med. Jul. 2013;11:160.
Chames, P. et al, Therapeutic antibodies: successes, limitations and hopes for the future. Br J Pharmacol. May 2009;157(2):220-233.
Cochlovius, B. et al, Treatment of human B cell lymphoma xenografts with a CD3 x CD19 diabody and T cells. J Immunol. Jul. 2000;165(2):888-895.
Davis, J.H. et al, SEEDbodies: fusion proteins based on strand-exchange engineered domain (SEED) CH3 heterodimers in an Fc analogue platform for asymmetric binders or immunofusions and bispecific antibodies. Protein Eng Des Sel. Apr. 2010;23(4):195-202.
De Gast, G.C. et al, CD8 T cell activation after intravenous administration of CD3 x CD19 bispecific antibody in patients with non-Hodgkin lymphoma. Cancer Immunol Immunother. Jun. 1995;40(6):390-396.
Kang, J.C. et al, Engineering multivalent antibodies to target heregulin-induced HER3 signaling in breast cancer cells. MAbs. Mar.-Apr. 2014;6(2):340-353.
Lewis, S.M. et al, Generation of bispecific IgG antibodies by structure-based design of an orthogonal Fab interface. Nature Biotechnology Feb. 2014; 32(2):191-198.
Lum, L.G. et al., Targeting T Cells with Bispecific Antibodies for Cancer Therapy. BioDrugs, Dec. 2011; 25 (6):365-379.
Mau-Sorensen, M., et al., A phase I trial of intravenous catumaxomab: a bispecific monoclonal antibody targeting EpCAM and the T cell coreceptor CD3 Cancer Chemotherapy and Pharmacol., May 2015; 75(5):1065-1073.
Moore, G.L. et al, A novel bispecific antibody format enables simultaneous bivalent and monovalent co-engagement of distinct target antigens MAbs Nov.-Dec. 2011;3(6):546-557.
Mcdonagh, C.F. et al, Antitumor activity of a novel bispecific antibody that targets the ErbB2/ErbB3 oncogenic unit and inhibits heregulin-induced activation of ErbB3. Mol Cancer Ther. Mar. 2012;11(3):582-593.
Nordstrom, J.L. et al, Anti-tumor activity and toxicokinetics analysis of MGAH22, an anti-HER2 monoclonal antibody with enhanced Fcγ receptor binding properties. Breast Cancer Res. 2011;13(6):R123.
Stanglmaier, M. et al, Bi20 (fBTA05), a novel trifunctional bispecific antibody (anti-CD20 x anti-CD3), mediates efficient killing of B-cell lymphoma cells even with very low CD20 expression levels. Int J Cancer. Sep. 2008; 123 (5):1181-1189.
Teachey, D.T. et al, Cytokine release syndrome after blinatumomab treatment related to abnormal macrophage activation and ameliorated with cytokine-directed therapy. Blood. Jun. 2013;121(26):5154-5157.
Tisoncik, J.R. et al, Into the eye of the cytokine storm. Microbiol Mol Biol Rev. Mar. 2012;76(1):16-32.

(56) References Cited

OTHER PUBLICATIONS

Troise, F. et al, Differential binding of human immunoagents and Herceptin to the ErbB2 receptor. FEBS J. Oct. 2008;275(20):4967-4979.

Wolf, E. et al, BiTEs: bispecific antibody constructs with unique anti-tumor activity. Drug Discov Today. Sep. 2005;10 (18):1237-1244.

Muromonab-CD3 (MeSH-NCBI htttps://www.ncbi.nlm.nih.gov/mesh/?term=muromonab, 1992) (Year: 1992).

Teplizumab (MeSH-NCBI, https://www.ncbi.nlm.nih.gov/mesh/?term=teplizumab, Aug. 3, 2005) (Year: 2005).

Blincytotm (blinatumomab) (Prescribing Information Dec. 2014) (Year: 2014).

U.S. Appl. No. 13/941,449 Restriction Requirement dated Dec. 3, 2015.

U.S. Appl. No. 13/941,449 Non-Final Office Action dated Apr. 13, 2016.

U.S. Appl. No. 13/941,449 Final Office Action dated Oct. 31, 2016.

U.S. Appl. No. 13/941,449 Non-Final Office Action dated Dec. 21, 2017.

U.S. Appl. No. 13/941,449 Final Office Action dated Jul. 24, 2018.

U.S. Appl. No. 13/941,449 Non-Final Office Action dated Feb. 13, 2019.

U.S. Appl. No. 16/256,824 Restriction Requirement dated Oct. 16, 2019.

U.S. Appl. No. 16/256,824 Non-Final Office Action dated Jan. 17, 2020.

U.S. Appl. No. 14/893,503 Restriction Requirement dated Dec. 28, 2017.

U.S. Appl. No. 14/893,503 Non-Final Office Action re-dated Jun. 25, 2018.

U.S. Appl. No. 14/893,503 Final Office Action dated Jan. 18, 2019.

U.S. Appl. No. 14/893,503 Non-Final Office Action dated Jul. 9, 2019.

U.S. Appl. No. 14/893,503 Final Office Action dated Dec. 20, 2019.

U.S. Appl. No. 14/903,184 Restriction Requirement dated Jun. 23, 2017.

U.S. Appl. No. 14/903,184 Non-Final Office Action dated Feb. 2, 2018.

U.S. Appl. No. 15/109,709 Restriction Requirement dated Aug. 3, 2017.

\* cited by examiner

CD19 Sequences:

hVL humanized sequences:

```
Kabat             10             20                30             40         50  L2
HD37      DIQLTQSPASLAVSLGQRATISC KASQSVDYDGDSYLN WYQQIPGQPPKLLIY DASNLVS
hVL2      DIQLTQSPSSLSASVGDRATITC RASQSVDYDGDSYLN WYQQKPGKAPKLLIY DASNLVS
hVL2(D-E) DIQLTQSPSSLSASVGDRATITC RASQSVDYEGDSYLN WYQQKPGKAPKLLIY DASNLVS
hVL2(D-S) DIQLTQSPSSLSASVGDRATITC RASQSVDYSGDSYLN WYQQKPGKAPKLLIY DASNLVS Kabat      60             70             80         90  L3     100
HD37      GIPPRFSGSGSGTDFTLNIHPVEKVDAATYHC QQSTEDPWT FGGGTKLEIK
hVL2      GIPSRFSGSGSGTDFTLTISSVQPEDAATYYC QQSTEDPWT FGCGTKLEIK
hVL2(D-E) GIPSRFSGSGSGTDFTLTISSVQPEDAATYYC QQSTEDPWT FGCGTKLEIK
hVL2(D-S) GIPSRFSGSGSGTDFTLTISSVQPEDAATYYC QQSTEDPWT FGCGTKLEIK
``` hVH humanized sequences:

```
Kabat             10             20               30  H1        40              50  H2          60
HD37      QVQLQQSGAELVRPGSSVKISCKAS GYAFSSYWMN WVKQRPGQGLEWIG QIWPGDGDTN YNGKFKG
hVH2      QVQLVQSGAEVKKPGASVKISCKAS GYAFSSYWMN WVRQAPGQCLEWIG QIWPGDGDTN YAQKFQG
hVH3      QVQLVQSGAEVKKPGASVKISCKAS GYAFSSYWMN WVRQAPGQCLEWIG QIWPGDGDTN YAQKFQG Kabat      70             80             90           100  H3           110
HD37      KATLTADESSSTAYMQLSSLASEDSAVYFCAR RETTTVGRYYYAMDY WGQGTTVTVSS
hVH2      RATLTADTSTSTAYMELSSLRSEDTAVYYCAR RETTTVGRYYYAMDY WGQGTTVTVSS
hVH3      RATLTADESTSTAYMELSSLRSEDTAVYYCAR RETTTVGRYYYAMDY WGQGTTVTVSS
```

FIG. 2

| Table A | |
|---|---|
| Kabat VL kappa | HD37_LC |
| 1 | D |
| 2 | I |
| 3 | Q |
| 4 | L |
| 5 | T |
| 6 | Q |
| 7 | S |
| 8 | P |
| 9 | A |
| 10 | S |
| 11 | L |
| 12 | A |
| 13 | V |
| 14 | S |
| 15 | L |
| 16 | G |
| 17 | Q |
| 18 | R |
| 19 | A |
| 20 | T |
| 21 | I |
| 22 | S |
| 23 | C |
| 24 | K |
| 25 | A |
| 26 | S |
| 27 | Q |
| 27b | S |
| 27c | V |
| 27d | D |
| 27e | Y |
| 28 | D |
| 29 | G |
| 30 | D |
| 31 | S |
| 32 | Y |
| 33 | L |
| 34 | N |
| 35 | W |
| 36 | Y |
| 37 | Q |
| 38 | Q |
| 39 | I |
| 40 | P |
| 41 | G |
| 42 | Q |
| 43 | P |

| Table A | |
|---|---|
| Kabat VL kappa | HD37_LC |
| 44 | P |
| 45 | K |
| 46 | L |
| 47 | L |
| 48 | I |
| 49 | Y |
| 50 | D |
| 51 | A |
| 52 | S |
| 53 | N |
| 54 | L |
| 55 | V |
| 56 | S |
| 57 | G |
| 58 | I |
| 59 | P |
| 60 | P |
| 61 | R |
| 62 | F |
| 63 | S |
| 64 | G |
| 65 | S |
| 66 | G |
| 67 | S |
| 68 | G |
| 69 | T |
| 70 | D |
| 71 | F |
| 72 | T |
| 73 | L |
| 74 | N |
| 75 | I |
| 76 | H |
| 77 | P |
| 78 | V |
| 79 | E |
| 80 | K |
| 81 | V |
| 82 | D |
| 83 | A |
| 84 | A |
| 85 | T |
| 86 | Y |
| 87 | H |
| 88 | C |
| 89 | Q |
| 90 | Q |

| Table A | |
|---|---|
| Kabat VL kappa | HD37_LC |
| 91 | S |
| 92 | T |
| 93 | E |
| 94 | D |
| 95 | P |
| 95a | W |
| 95b | T |
| 98 | F |
| 99 | G |
| 100 | G |
| 101 | G |
| 102 | T |
| 103 | K |
| 104 | L |
| 105 | E |
| 106 | I |
| 107 | K |

FIG. 3

Table B

| Kabat VH | HD37_HC |
|---|---|
| 1 | Q |
| 2 | V |
| 3 | Q |
| 4 | L |
| 5 | Q |
| 6 | Q |
| 7 | S |
| 8 | G |
| 9 | A |
| 10 | E |
| 11 | L |
| 12 | V |
| 13 | R |
| 14 | P |
| 15 | G |
| 16 | S |
| 17 | S |
| 18 | V |
| 19 | K |
| 20 | I |
| 21 | S |
| 22 | C |
| 23 | K |
| 24 | A |
| 25 | S |
| 26 | G |
| 27 | Y |
| 28 | A |
| 29 | F |
| 30 | S |
| 31 | S |
| 34 | Y |
| 35 | W |
| 35a | M |
| 35b | N |
| 36 | W |
| 37 | V |
| 38 | K |
| 39 | Q |
| 40 | R |
| 41 | P |
| 42 | G |
| 43 | Q |
| 44 | G |
| 45 | L |
| 46 | E |
| 47 | W |

| Kabat VH | HD37_HC |
|---|---|
| 48 | I |
| 49 | G |
| 50 | Q |
| 51 | I |
| 52 | W |
| 52a | P |
| 52b | G |
| 54 | D |
| 55 | G |
| 56 | D |
| 57 | T |
| 58 | N |
| 59 | Y |
| 60 | N |
| 61 | G |
| 62 | K |
| 63 | F |
| 64 | K |
| 65 | G |
| 66 | K |
| 67 | A |
| 68 | T |
| 69 | L |
| 70 | T |
| 71 | A |
| 72 | D |
| 73 | E |
| 74 | S |
| 75 | S |
| 76 | T |
| 77 | A |
| 78 | Y |
| 79 | M |
| 80 | Q |
| 81 | L |
| 82 | S |
| 82a | S |
| 82b | L |
| 82b | A |
| 83 | S |
| 84 | E |
| 85 | D |
| 86 | S |
| 87 | A |
| 88 | V |
| 89 | Y |
| 90 | Y |

| Kabat VH | HD37_HC |
|---|---|
| 91 | F |
| 92 | C |
| 93 | A |
| 95 | R |
| 96 | R |
| 97 | E |
| 98 | T |
| 99 | T |
| 100 | V |
| 100a | G |
| 100b | R |
| 100c | Y |
| 100d | Y |
| 100e | Y |
| 100f | A |
| 100g | M |
| 100h | D |
| 100i | Y |
| 102 | W |
| 103 | G |
| 104 | Q |
| 105 | G |
| 106 | T |
| 107 | T |
| 108 | V |
| 109 | T |
| 110 | V |
| 111 | V |
| 112 | S |
| 113 | S |

FIG.3 (cont'd...)

Anti-CD3 sequences

VH stabilized sequences:

```
              10         20          30         40         50         60
Kabat VH      QVQLVQSGGGVVQPGRSLRLSCKAS GYTFTRYTMH WVRQAPGKGLEWIG YINPSRGYTN YNQKVKD
teplizumab    QVQLVQSGGGVVQPGRSLRLSCKAS GYTFTRYTMH WVRQAPGKGLEWIG YINPSRGYTN YNQKVKD
OKT3          QVQLQQSGAELARPGASVKMSCKAS GYTFTRYTMH WVKQRPGQGLEWIG YINPSRGYTN YNQKFKD
hVH1          QVQLVQSGGGVVQPGRSLRLSCKAS GYTFTRYTMH WVRQAPGKGLEWIG YINPSRGYTN YNQKVKG
hVH2          QVQLVQSGGGVVQPGRSLRLSCKAS GYTFTRYTMH WVRQAPGKGLEWIG YINPSRGYTN YNQKVKG 70         80         90              110
Kabat VH      RFTISRDNSKNTAFLQMDSLRPEDTGVYFCAR YDDDHYCLDY WGQGTPVTVSS
teplizumab    RFTISRDNSKNTAFLQMDSLRPEDTGVYFCAR YDDDHYCLDY WGQGTTLTVSS
OKT3          KATLTTDKSSSTAYMQLSSLTSEDSAVYYCAR YDDDHYCLDY WGQGTTLTVSS
hVH1          RFTISTDKSKNTAYLQMDSLRAEDTGVYFCAR YDDDHYSLDY WGQGTLVTVSS
hVH2          RFTISTDNSKNTAYLQMDSLRAEDTGVYFCAR YDDDHYSLDY WGQGTLVTVSS
```

VL stabilized sequences:

```
              10         20          30         40         50
Kabat VL      DIQMTQSPSSLSASVGDRVTITC SASSSVSYMN WYQQTPGKAPKRWIY DTSKLAS
teplizumab    DIQMTQSPSSLSASVGDRVTITC SASSSVSYMN WYQQTPGKAPKRWIY DTSKLAS
OKT3          QIVLTQSPAIMSASPGEKVTMTC SASSSVSYMN WYQQKSGTSPKRWIY DTSKLAS
hVL1          DIQMTQSPSSLSASVGDRVTITC SASSSVSYMN WYQQKPGKAPKRWIY DTSKLAS
hVL2          DIQMTQSPSSLSASVGDRVTITC SASSSVSYMN WYQQKPGKAPKRLIY DTSKLAS 60         70         80         90         100
Kabat VL      GVPSRFSGSGSGTDYTFTISSLQPEDIATYYC QQWSSNPFT FGQGTKLQIK
teplizumab    GVPAHFRGSGSGTSYSLTISGMEAEDAATYYC QQWSSNPFT FGSGTKLEIK
OKT3          GVPSRFSGSGSGTDYTLTISSLQPEDAATYYC QQWSSNPFT FGQGTKLEIK
hVL1          GVPSRFSGSGSGTDYTLTISSLQPEDAATYYC QQWSSNPFT FGQGTKLEIK
hVL1          GVPSRFSGSGSGTDYTLTISSLQPEDAATYYC QQWSSNPFT FGQGTKLEIK
```

FIG.4

Table A

| Kabat VH | OKT3 HC |
|---|---|
| 1 | Q |
| 2 | V |
| 3 | Q |
| 4 | L |
| 5 | Q |
| 6 | Q |
| 7 | S |
| 8 | G |
| 9 | A |
| 10 | E |
| 11 | L |
| 12 | A |
| 13 | R |
| 14 | P |
| 15 | G |
| 16 | A |
| 17 | S |
| 18 | V |
| 19 | K |
| 20 | M |
| 21 | S |
| 22 | C |
| 23 | K |
| 24 | A |
| 25 | S |
| 26 | G |
| 27 | Y |
| 28 | T |
| 29 | F |
| 30 | T |
| 31 | R |
| 32 | Y |
| 33 | T |
| 34 | M |
| 35 | H |
| 36 | W |
| 37 | V |
| 38 | K |
| 39 | Q |
| 40 | R |
| 41 | P |
| 42 | G |
| 43 | Q |
| 44 | G |
| 45 | L |
| 46 | E |
| 47 | W |
| 48 | I |
| 49 | G |
| 50 | Y |
| 51 | I |
| 52 | N |
| 52A | P |
| 53 | S |
| 54 | R |
| 55 | G |
| 56 | Y |
| 57 | T |
| 58 | N |
| 59 | Y |
| 60 | N |
| 61 | Q |
| 62 | K |
| 63 | F |
| 64 | K |
| 65 | D |
| 66 | K |
| 67 | A |
| 68 | T |
| 69 | L |
| 70 | T |
| 71 | T |
| 72 | D |
| 73 | K |
| 74 | S |
| 75 | S |
| 76 | S |
| 77 | T |
| 78 | A |
| 79 | Y |
| 80 | M |
| 81 | Q |
| 82 | L |
| 82A | S |
| 82B | S |
| 82C | L |
| 83 | T |
| 84 | S |
| 85 | E |
| 86 | D |
| 87 | S |
| 88 | A |
| 89 | V |
| 90 | Y |
| 91 | Y |
| 92 | C |
| 93 | A |
| 94 | R |
| 95 | Y |
| 96 | Y |
| 97 | D |
| 98 | D |
| 99 | H |
| 100 | Y |
| 100A | C |
| 100B | L |
| 101 | D |
| 102 | Y |
| 103 | W |
| 104 | G |
| 105 | Q |
| 106 | G |
| 107 | T |
| 108 | T |
| 109 | L |
| 110 | T |
| 111 | V |
| 112 | S |
| 113 | S |

FIG.5

Table B

| Kabat VL | OKT3 LC |
|---|---|
| 1 | Q |
| 2 | I |
| 3 | V |
| 4 | L |
| 5 | T |
| 6 | Q |
| 7 | S |
| 8 | P |
| 9 | A |
| 10 | I |
| 11 | M |
| 12 | S |
| 13 | A |
| 14 | S |
| 15 | P |
| 16 | G |
| 17 | E |
| 18 | K |
| 19 | V |
| 20 | T |
| 21 | M |
| 22 | T |
| 23 | C |
| 24 | S |
| 25 | A |
| 26 | S |
| 27 | S |
| 28 | - |
| 29 | S |
| 30 | V |
| 31 | S |
| 32 | Y |
| 33 | M |
| 34 | N |
| 35 | W |
| 36 | Y |
| 37 | Q |
| 38 | Q |
| 39 | K |
| 40 | S |
| 41 | G |
| 42 | T |
| 43 | S |
| 44 | P |
| 45 | K |
| 46 | R |
| 47 | W |
| 48 | I |
| 49 | Y |
| 50 | D |
| 51 | T |
| 52 | S |
| 53 | K |
| 54 | L |
| 55 | A |
| 56 | S |
| 57 | G |
| 58 | V |
| 59 | P |
| 60 | A |
| 61 | H |
| 62 | F |
| 63 | R |
| 64 | G |
| 65 | S |
| 66 | G |
| 67 | S |
| 68 | G |
| 69 | T |
| 70 | S |
| 71 | Y |
| 72 | S |
| 73 | L |
| 74 | T |
| 75 | I |
| 76 | S |
| 77 | G |
| 78 | M |
| 79 | E |
| 80 | A |
| 81 | E |
| 82 | D |
| 83 | A |
| 84 | A |
| 85 | T |
| 86 | Y |
| 87 | Y |
| 88 | C |
| 89 | Q |
| 90 | Q |
| 91 | W |
| 92 | S |
| 93 | S |
| 94 | N |
| 95 | P |
| 96 | F |
| 97 | T |
| 98 | F |
| 99 | G |
| 100 | S |
| 101 | G |
| 102 | T |
| 103 | K |
| 104 | L |
| 105 | E |
| 106 | I |
| 107 | K |

FIG. 5 (cont'd...)

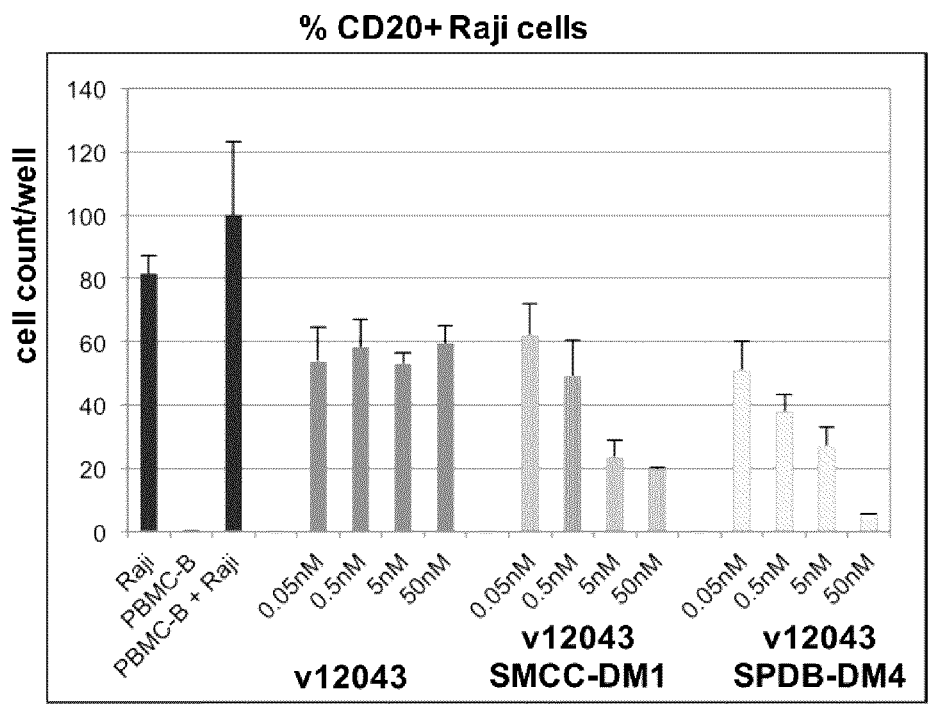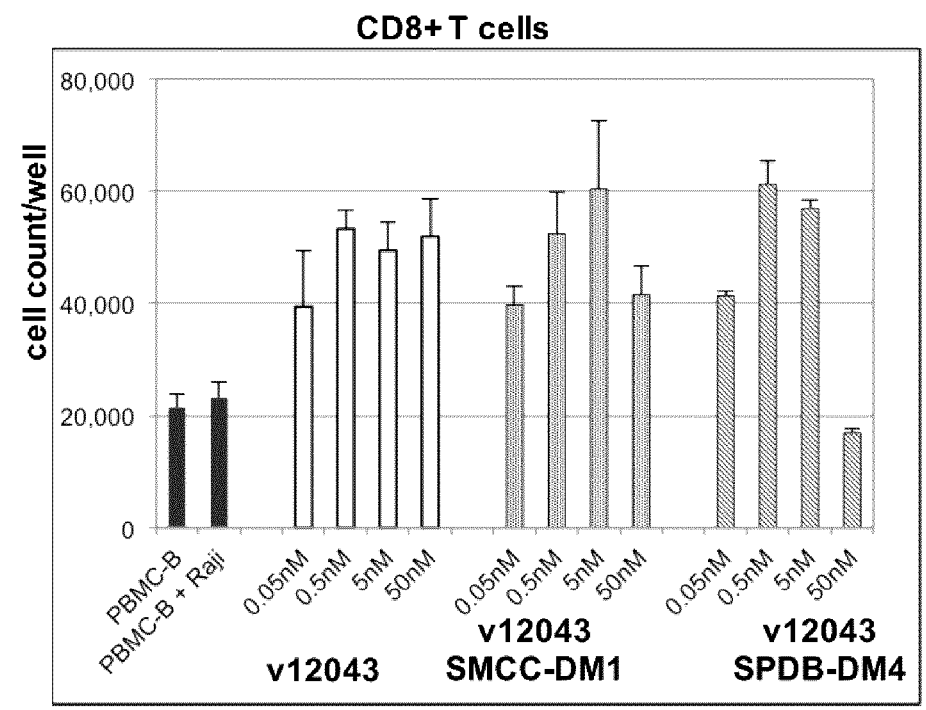
FIG. 11

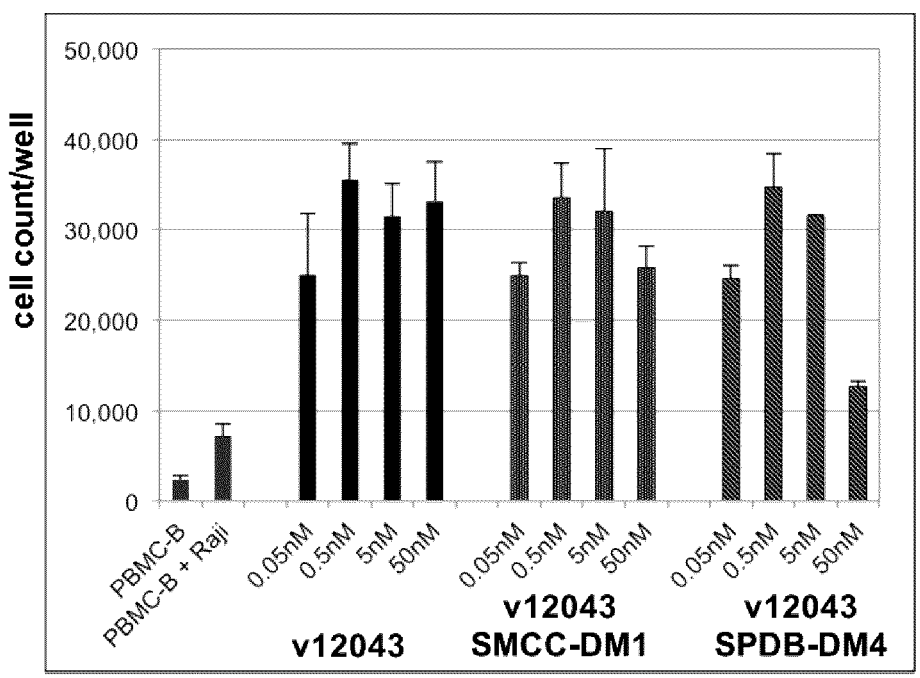
FIG. 11 (cont'd...)

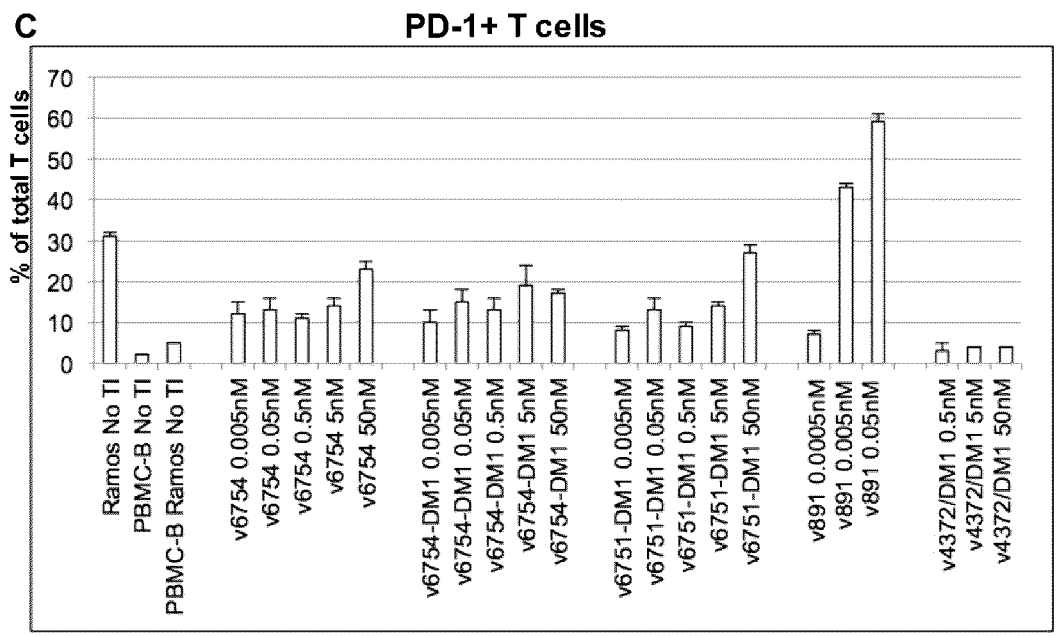
FIG. 13 (cont'd...)

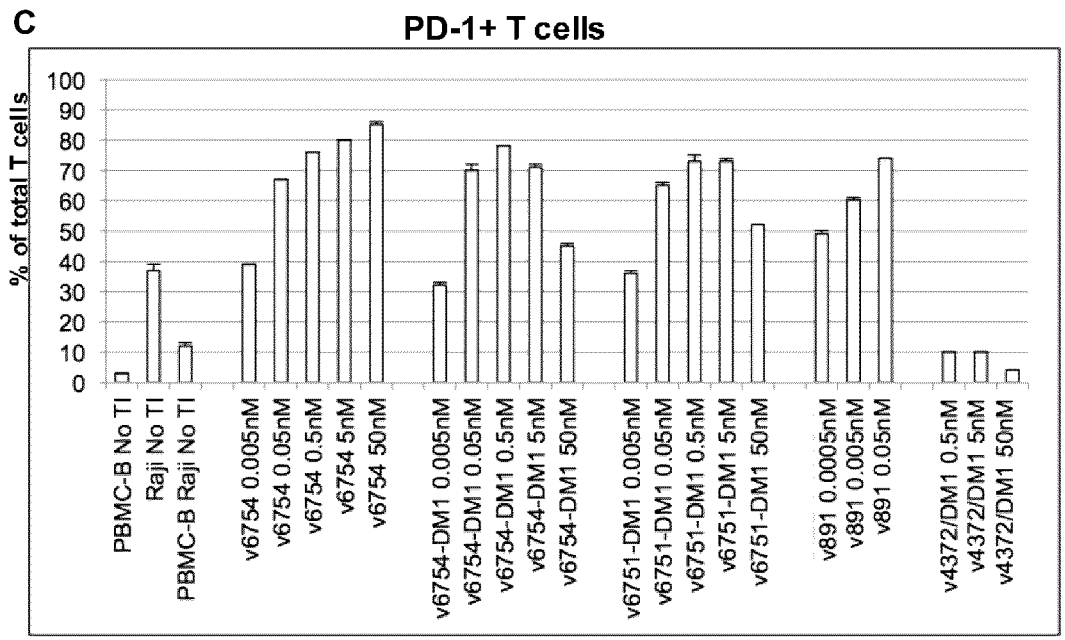
FIG. 14 (cont'd...)

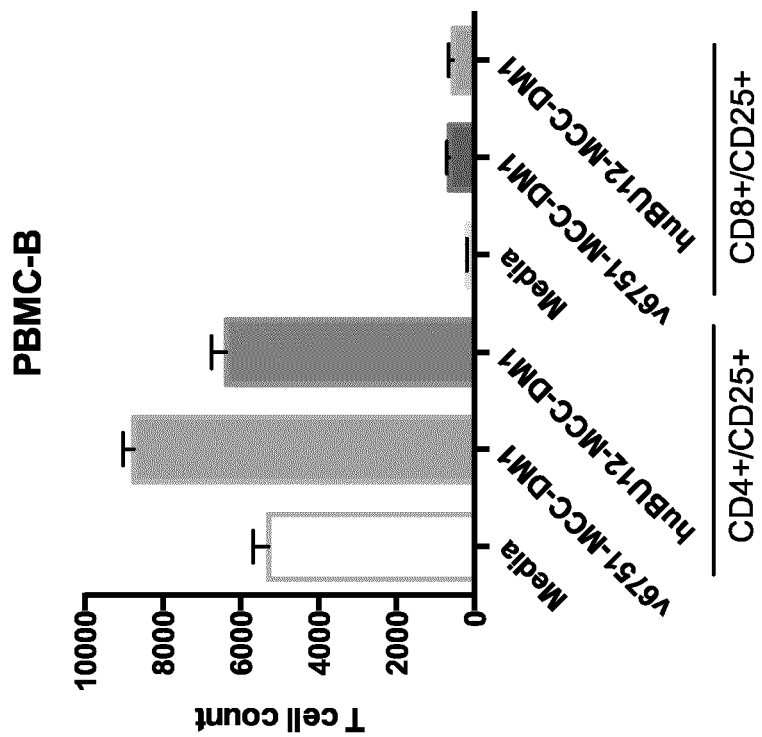
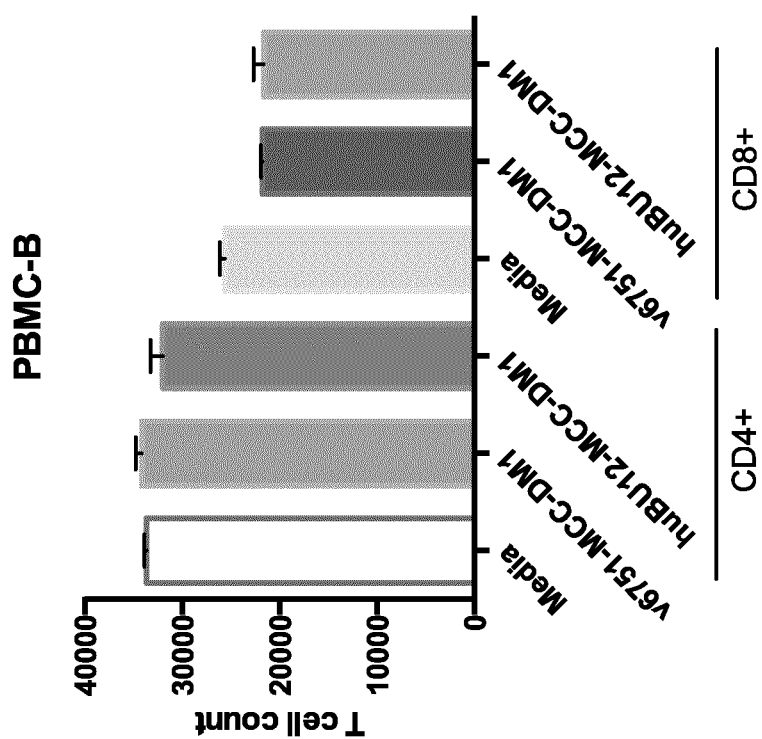
FIG.19

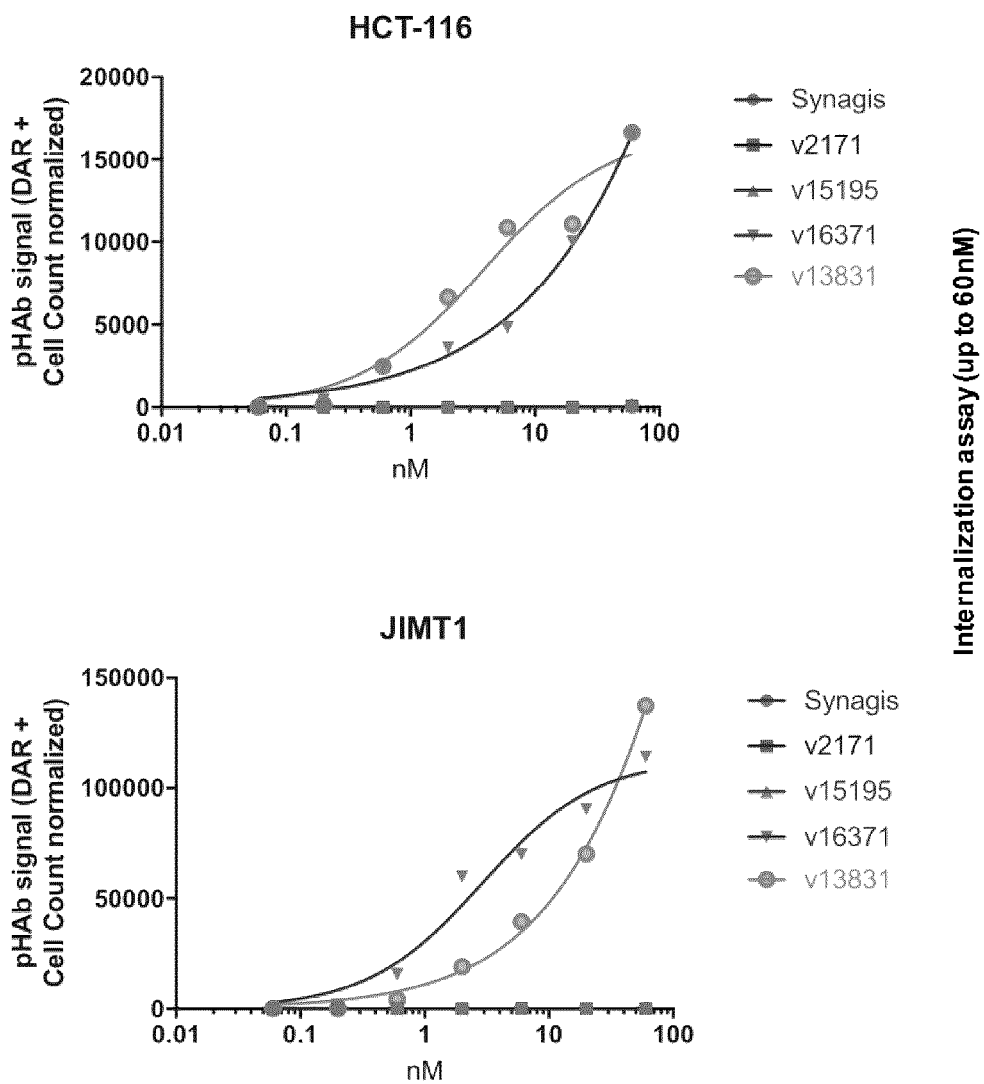
FIG. 24 (cont'd...)

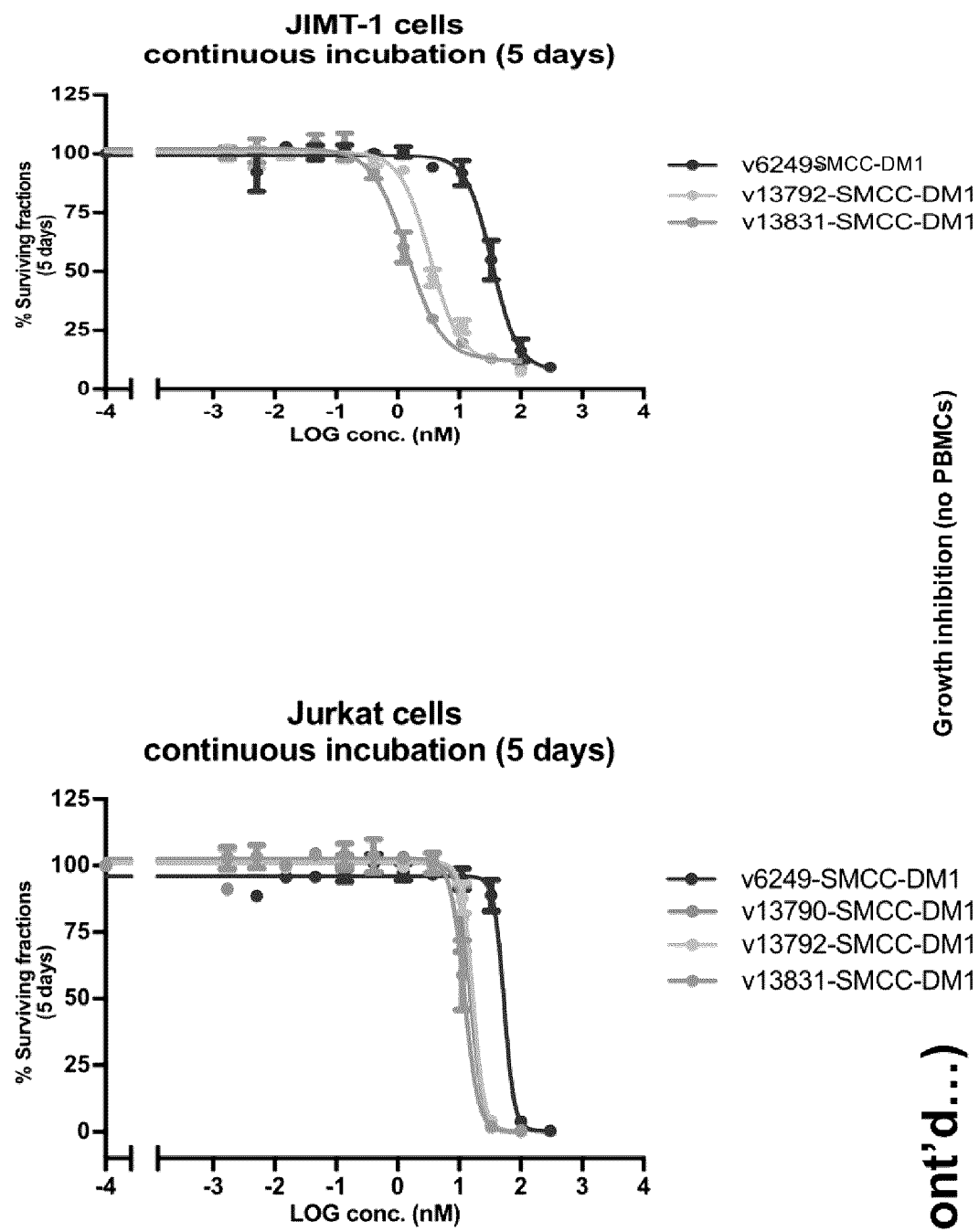
FIG. 25 (Cont'd...)

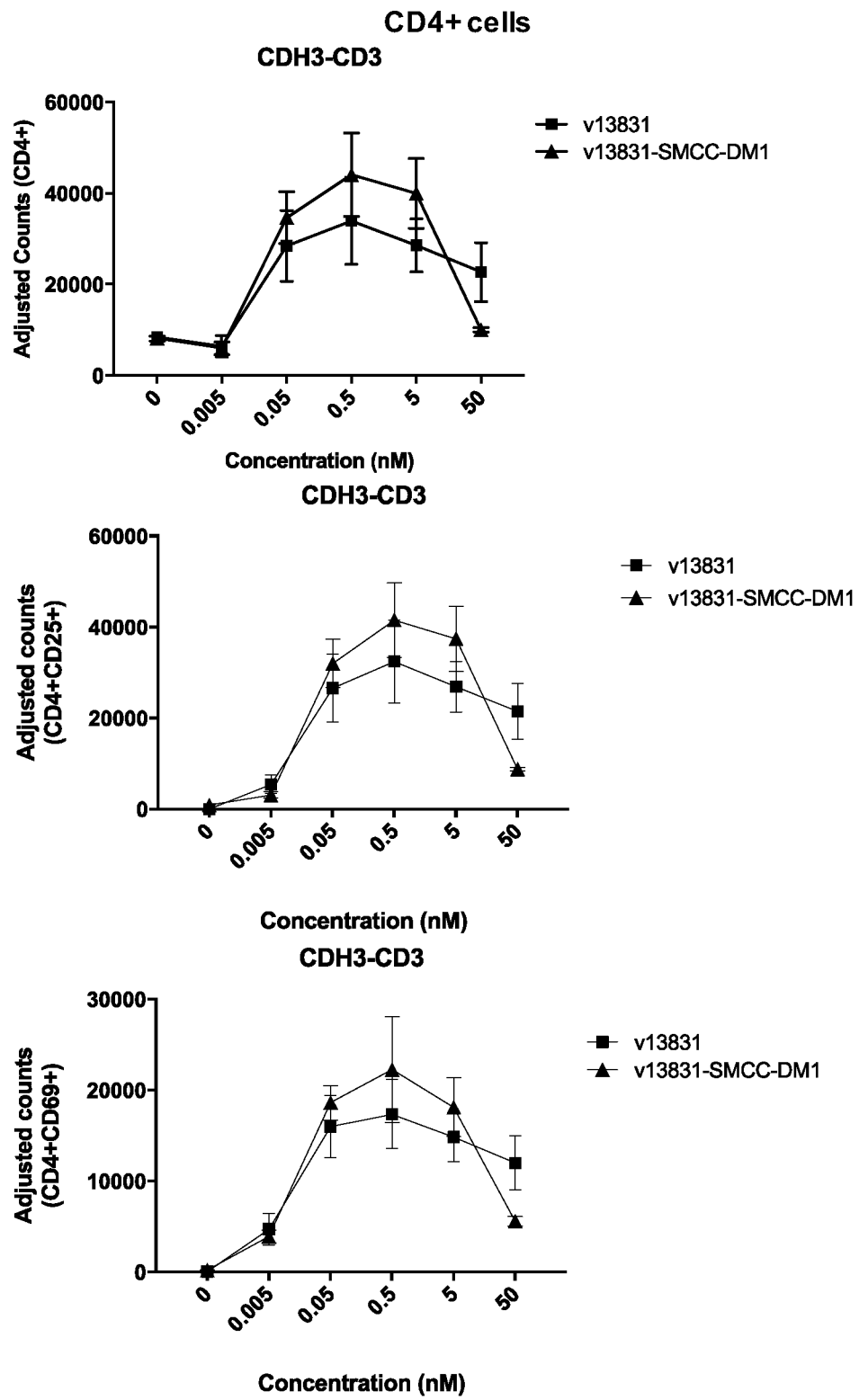
FIG. 27 (Cont'd...)

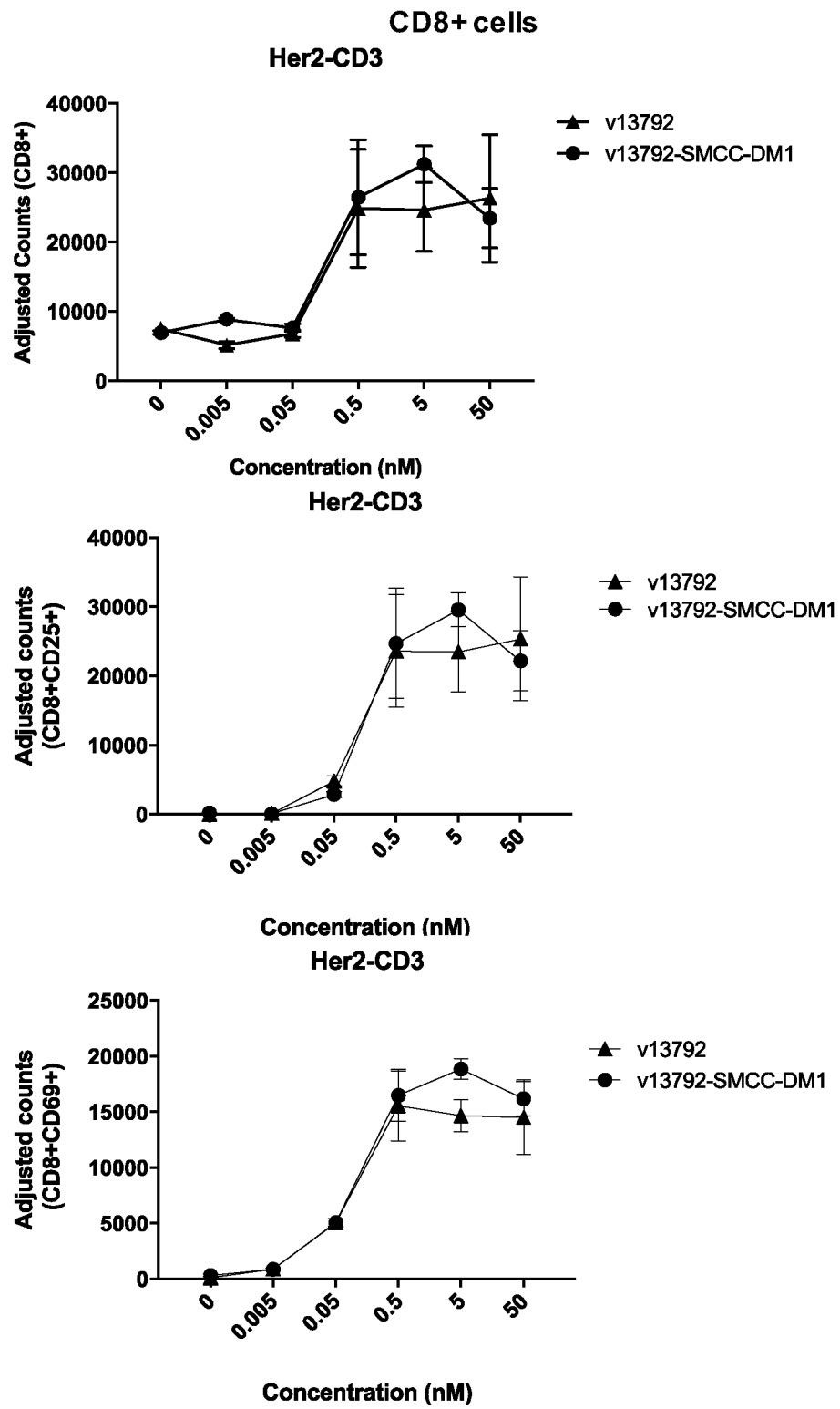
FIG. 27 (Cont'd...)

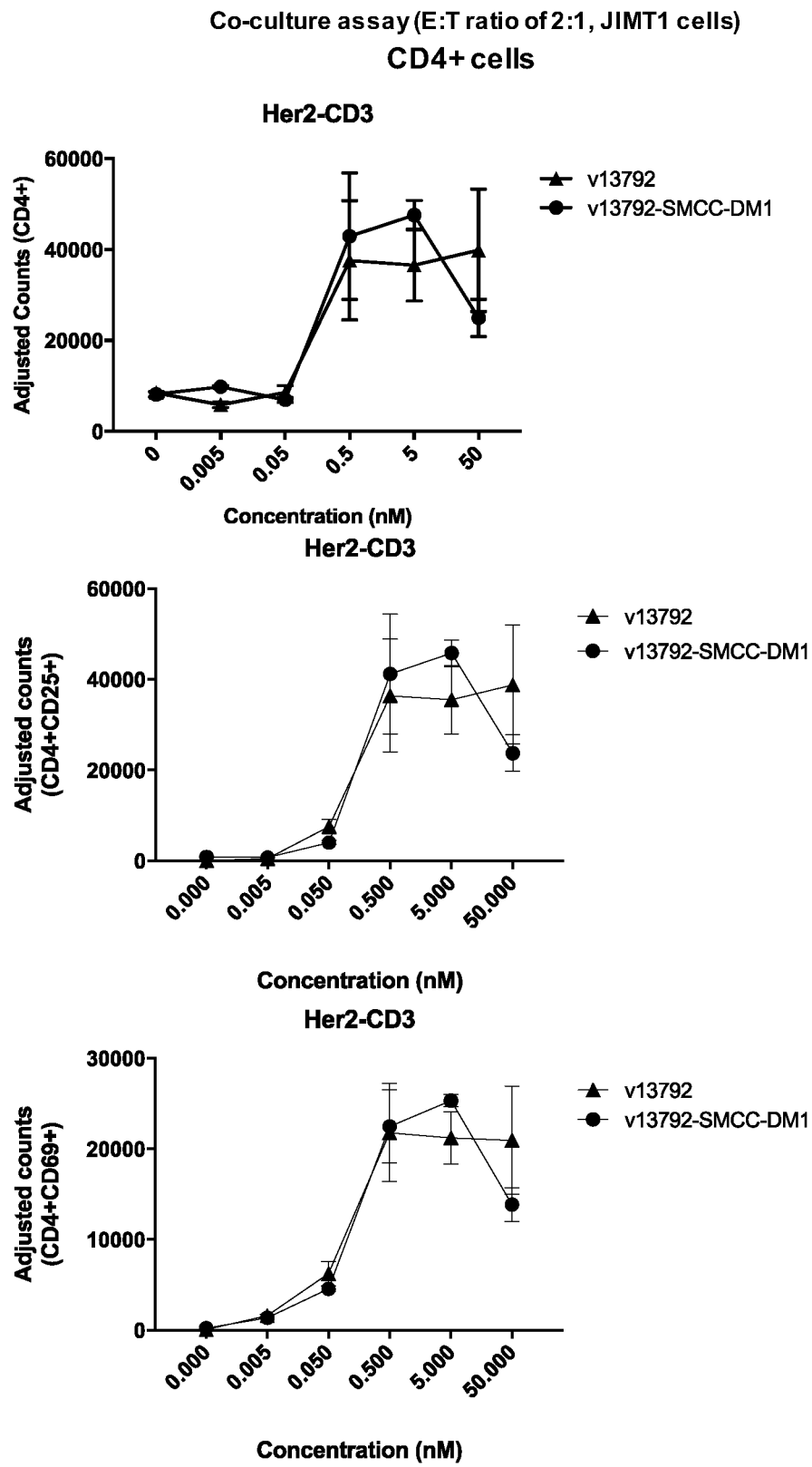
FIG. 27 (Cont'd...)

DRUG-CONJUGATED BI-SPECIFIC ANTIGEN-BINDING CONSTRUCTS

CROSS REFERENCE TO RELATED APPLICATIONS

This application is a 35 U.S.C. 371 national stage filing of International Application No. PCT/CA2016/050839, filed on Jul. 15, 2016, which claims the benefit of U.S. Provisional Application No. 62/193,569, filed on Jul. 16, 2015 and U.S. Provisional Application No. 62/193,056, filed on Jul. 15, 2015. These applications are hereby incorporated in their entirety by reference.

SEQUENCE LISTING

The instant application contains a Sequence Listing which has been submitted electronically in ASCII format and is hereby incorporated by reference in its entirety. Said ASCII copy, created on Aug. 18, 2016, is named 34390PCT_CRF_sequencelisting.txt and is 854,022 bytes in size.

FIELD OF THE INVENTION

The field of the invention is drug-conjugated bi-specific antigen-binding constructs, e.g., antibodies, comprising a CD3 antigen-binding polypeptide construct, e.g., a CD3 binding domain and a second antigen-binding polypeptide construct, e.g., a domain that binds a target antigen expressed on a target cell, e.g. a tumor cell.

BACKGROUND OF THE INVENTION

In the realm of therapeutic proteins, antibodies with their multivalent target binding features are excellent scaffolds for the design of drug candidates. Advancing these features further, designed bi-specific antibodies and other fused multispecific therapeutics exhibit dual or multiple target specificities and an opportunity to create drugs with novel modes of action. The development of such multivalent and multispecific therapeutic proteins with favorable pharmacokinetics and functional activity has been a challenge.

Bi-specific antibodies capable of targeting T cells to tumor cells have been identified and tested for their efficacy in the treatment of cancers. Blinatumomab is an example of a bi-specific anti-CD3-CD19 antibody in a format called BiTE™ (Bi-specific T-cell Engager) that has been identified for the treatment of B-cell diseases such as relapsed B-cell non-Hodgkin lymphoma and chronic lymphocytic leukemia (Baeuerle et al (2009)12:4941-4944) and is FDA approved. T cell engagers directed against other tumor-associated target antigens have also been made, and several have entered clinical trials: AMG110/MT110 EpCAM for lung cancer, gastric cancer and colorectal cancer; AMG211/MEDI565 CEA for gastrointestinal adenocarcinoma; and AMG 212/BAY2010112 PSMA for prostate cancer (see Suruadevara, C. M. et al, Oncoimmunology. 2015 June; 4(6): e1008339).

The BiTE™ format is a bi-specific single chain antibody construct that links variable domains derived from two different antibodies. Blinatumomab, is highly efficacious in B cell acute lymphocytic leukemia (ALL) with an overall response rate of over 80%, but despite the high efficacy many patients relapse shortly after or during the treatment. In addition, T cell engagers have been shown to be less effective in malignancies like chronic lymphocytic leukemia (CLL). There is a need for more efficacious and durable T cell engager therapies.

T cell engager antigen-binding constructs are described in the following: International application no. PCT/US2013/050411 filed on Jul. 13, 2013 and titled "Bispecific Asymmetric Heterodimers Comprising Anti-CD3 Constructs;" International application no. PCT/US2014/046436 filed on Jul. 11, 2014 and titled "Bispecific CD3 and CD19 Antigen Binding Constructs;" PCT/US2015/011664 filed on Jan. 15, 2015 and titled "Bispecific CD3 and CD19 Antigen Binding Constructs."

SUMMARY OF THE INVENTION

Described herein is a drug-conjugated antigen-binding construct comprising a first antigen-binding polypeptide construct that specifically binds a CD3 antigen expressed on T cells; and a second antigen-binding polypeptide construct that specifically binds a disease-associated target antigen expressed on a target cell. The first and second antigen-binding polypeptides are operably linked; and the antigen-binding construct is conjugated to a drug, optionally to 2 different drugs. In some embodiments, the drug-conjugated antigen-binding construct displays higher killing potency against target cells in vitro than a reference antigen-binding construct that is not conjugated to a drug. and does not substantially deplete T cells when administered to a subject. The drug-conjugated antigen-binding construct comprises one or more drug molecules. The drug-conjugated antigen binding construct may comprise a heterodimeric Fc comprising a first Fc polypeptide linked to the first antigen-binding polypeptide construct with or without a first linker and a second Fc polypeptide linked to the second antigen-binding polypeptide construct with or without a second linker. In some embodiments, the target antigen is CD19. In some embodiments, the target antigen is CDH3. In some embodiments, the target antigen is HER2. In some embodiments, the target antigen is CDH3. In some embodiments, the target antigen is EGFR. In some embodiments the target antigen is selected from Table LL.

One aspect of the present disclosure is a method of killing target cells that express a target antigen on the cell surface comprising contacting the target cells with an effective amount of a drug-conjugated antigen-binding construct in the presence of effector T cells, wherein the drug-conjugated antigen-binding construct comprises a first antigen-binding polypeptide construct that specifically binds a CD3 antigen expressed on the effector T cells, comprising a first heavy chain variable (VH) region and a first light chain variable (VL) region; a second antigen-binding polypeptide construct comprising a second VH region and a second VL region that specifically binds the target antigen; and at least one drug conjugated to the antigen-binding construct; wherein the first and second antigen-binding polypeptide constructs are operably linked; and the target antigen is not CD3; and wherein (a) the antigen-binding construct displays higher affinity to the target antigen than to CD3 as measured by SPR or FACS analysis; and/or (b) the antigen-binding construct displays higher killing potency against target cells bearing the target antigen than against T cells, as measured in an in vitro assay.

Another aspect of the present disclosure is a method of killing target cells that express a target antigen on the cell surface in a subject, comprising administering to the subject an effective amount of a drug-conjugated antigen-binding construct wherein the drug-conjugated antigen-binding construct comprises a first antigen-binding polypeptide construct that specifically binds a CD3 antigen expressed on the T cells of the subject, comprising a first heavy chain variable (VH) region and a first light chain variable (VL) region; a second antigen-binding polypeptide construct comprising a second VH region and a second VL region that specifically binds the target antigen; and at least one drug conjugated to the antigen-binding construct; wherein the first and second antigen-binding polypeptide constructs are operably linked; and the target antigen is not CD3; and wherein (a) the antigen-binding construct displays higher affinity to the target antigen than to CD3 as measured by SPR or FACS analysis; and/or (b) the antigen-binding construct displays higher killing potency against target cells bearing the target antigen than against T cells, as measured in an in vitro assay.

Another aspect of the present disclosure is a method of treating a disease, disorder or condition in a subject in need thereof comprising administering to the subject a therapeutically effective amount of a drug-conjugated antigen-binding construct wherein the drug-conjugated antigen-binding construct comprises a first antigen-binding polypeptide construct that specifically binds a CD3 antigen expressed on the T cells of the subject, comprising a first heavy chain variable (VH) region and a first light chain variable (VL) region; a second antigen-binding polypeptide construct comprising a second VH region and a second VL region that specifically binds the target antigen; and at least one drug conjugated to the antigen-binding construct; wherein the first and second antigen-binding polypeptide constructs are operably linked; and the target antigen is not CD3; and wherein (a) the antigen-binding construct displays higher affinity to the target antigen than to CD3 as measured by SPR or FACS analysis; and/or (b) the antigen-binding construct displays higher killing potency against target cells bearing the target antigen than against T cells, as measured in an in vitro assay.

Another aspect of the present disclosure is a composition consisting of a drug-conjugated antigen-binding construct comprising a first antigen-binding polypeptide construct comprising a first VH region, and optionally a first VL region, that specifically binds a CD3 antigen expressed on a T cell; a second antigen-binding polypeptide construct comprising a second VH region, and optionally a second VL region, that specifically binds a target antigen expressed on a target cell; and at least one drug conjugated to the antigen-binding construct; wherein the first and second antigen-binding polypeptide constructs are operably linked; and wherein the target antigen is not CD3; and wherein the target antigen is not CD3; and wherein the antigen-binding construct displays higher affinity to the target antigen than to CD3 as measured by SPR or FACS analysis. In some embodiments embodiment, the antigen-binding construct displays higher killing potency against target cells bearing the target antigen than against T cells, as measured in an in vitro assay.

Another aspect of the present disclosure is an antigen-binding construct that binds to a CD3 epsilon subunit comprising a first antigen binding polypeptide construct comprising a VH region and a VL region wherein the VH region comprises 3 CDRs comprising the amino acid sequences of the VH CDRs of the humanized variant of OKT 3 in Table S1; and the VL region comprises 3 CDRs comprising the amino acid sequences of the VL CDRs of the humanized variant of OKT3 in Table S1. In one embodiment, the construct comprises a VH region comprising an amino acid sequence selected from the amino acid sequence of hVH1 or hVH2 in FIG. 2 and an amino acid sequence that is at least 80, 85, 90, 95, 96, 97, 98 or 99% identical to the amino acid sequence of hVH1 or hVH2 in FIG. 4; and the VL region comprises an amino acid sequence selected from the amino acid sequence of hVL1 or hVL2 in FIG. 4 and an amino acid sequence that is at least 80, 85, 90, 95, 96, 97, 98 or 99% identical to the amino acid sequence of hVL1 or hVL2 in FIG. 4.

BRIEF DESCRIPTION OF THE FIGURES

FIG. 1A(i) shows a representation of an exemplary antigen-binding construct in which both of the antigen-binding domains of the antigen-binding construct are scFvs, with the VH and VL regions of each scFv connected with a polypeptide linker. Each scFv is also connected to one polypeptide chain of a heterodimeric Fc with a hinge polypeptide linker. The two polypeptide chains of the antigen-binding construct are covalently linked together via disulphide bonds (depicted as thick solid lines lines). FIG. 1A(ii) depicts a representation of an exemplary antigen-binding construct similar to 1A(i), except the CD3 binding domain is a Fab and the target antigen binding domain are scFvs. FIG. 1A(iii) depicts a similar antigen-binding construct in which the CD3 binding domain is an scFv and the target antigen binding domain is a Fab. FIG. 1A(iv) depicts a similar antigen-binding construct in which the both the CD3 and target antigen binding domains are Fabs.

FIG. 1B(i) shows a 4-(N-maleimidomethyl)cyclohexane-1-carboxylate (MCC)-DM1 conjugate in which the linker-toxin is conjugated via a lysine residue on the antigen binding construct; FIG. 1B(ii) shows an N-succinimidyl-4-(2-pyridyldithio)butanoate (SPDB)-DM4 conjugate in which the linker-toxin is conjugated via a lysine residue on the antigen binding construct; FIG. 1B(iii) shows a maleimidocaproyl-valine-citrulline-p-aminobenzyloxycarbonyl (mc-Val-Cit-PABC)-MMAE conjugate in which the linker-toxin is conjugated via a cysteine residue on the antigen binding construct. "Ab" represents the antigen binding construct, which may be any one of the designs shown in FIGS. 1A-1D. "n" represents the number of linker-toxin moieties conjugated to the antigen binding construct and is between 1 and 20.

FIG. 2 depicts humanized CD19 VL and VH sequences based on the mouse HD37 VL (SEQ ID NO: 1169) and VH (SEQ ID NO: 1173) sequences. Three humanized VL sequences have been provided: hVL2 (SEQ ID NO: 1170), hVL2 (D-E) (SEQ ID NO: 1171), and hVL2 (D-S) (SEQ ID NO: 1172). hVL2 (D-E) contains a D to E substitution in CDR L1, while hVL2 (D-S) contains a D to S substitution in CDR L1. Two humanized VH sequences have been provided: hVH2 (SEQ ID NO: 1174), and hVH3 (SEQ ID NO: 1175). The CDR sequences are identified by boxes. The CDRs identified in this figure are exemplary only. As is known in the art, the identification of CDRs may vary depending on the method used to identify them. Alternate CDR definitions for the anti-CD19 VL and VH sequences are shown in Table S1. Modifications to humanize these sequences with respect to the wild-type mouse HD37 antibody sequence are denoted by underlining.

FIG. 3 depicts a table showing the number according to Kabat for the anti-CD19 VH (SEQ ID NO: 1173) and VL (SEQ ID NO: 1169) sequences, based on the anti-CD19 HD37 antibody.

FIG. 4 depicts humanized CD3 VL and VH sequences based on the mouse OKT3 and teplizumab (a known humanized OKT3) sequences. Two VII sequences have been provided: hVH1 and hVH2. Two VL sequences have been provided: hVL1 and hVL2. The CDR sequences are identified by boxes. The CDRs identified in this figure are exemplary only. As is known in the art, the identification of CDRs may vary depending on the method used to identify them. Alternate CDR definitions for the anti-CD3 VL and VII sequences are shown in Table S1. Modifications to these sequences with respect to the wild-type teplizumab antibody sequence are denoted by underlining. FIG. 4 discloses SEQ ID NOS 1176-1183, respectively, in order of appearance.

FIG. 5 depicts a table showing the number according to Kabat for the anti-CD3 VH (SEQ ID NO: 1177) and VL (SEQ ID NO: 1181) sequences, based on the anti-CD3 OKT3 antibody.

FIG. 11 depicts the effects of various concentrations of unconjugated variant anti-CD3-CD19 variants 12043, v12043-DM1 and v12043-DM4 on (A) Raji cells, (CD19+) (B) CD8+ T cells and (C) CD8+/CD69+ T cells in 72-hour cultures of Raji cells incubated with allogenic peripheral blood mononuclear cells that had been depleted of B cells.

FIG. 19 depicts the effects of an exemplary anti-CD3-CD19 antigen-binding construct v6751, v6751 conjugated to DM1 and a control bivalent mono-specific antibody anti-CD19 antibody, huBU12, and huBU12 conjugated to DM1 on various T cell subpopulations in cultures of PBMC-B cells: CD4+. CD8+, CD4+/CD25+ and CD8+/CD25+.

DETAILED DESCRIPTION OF THE INVENTION

Figure 1A:
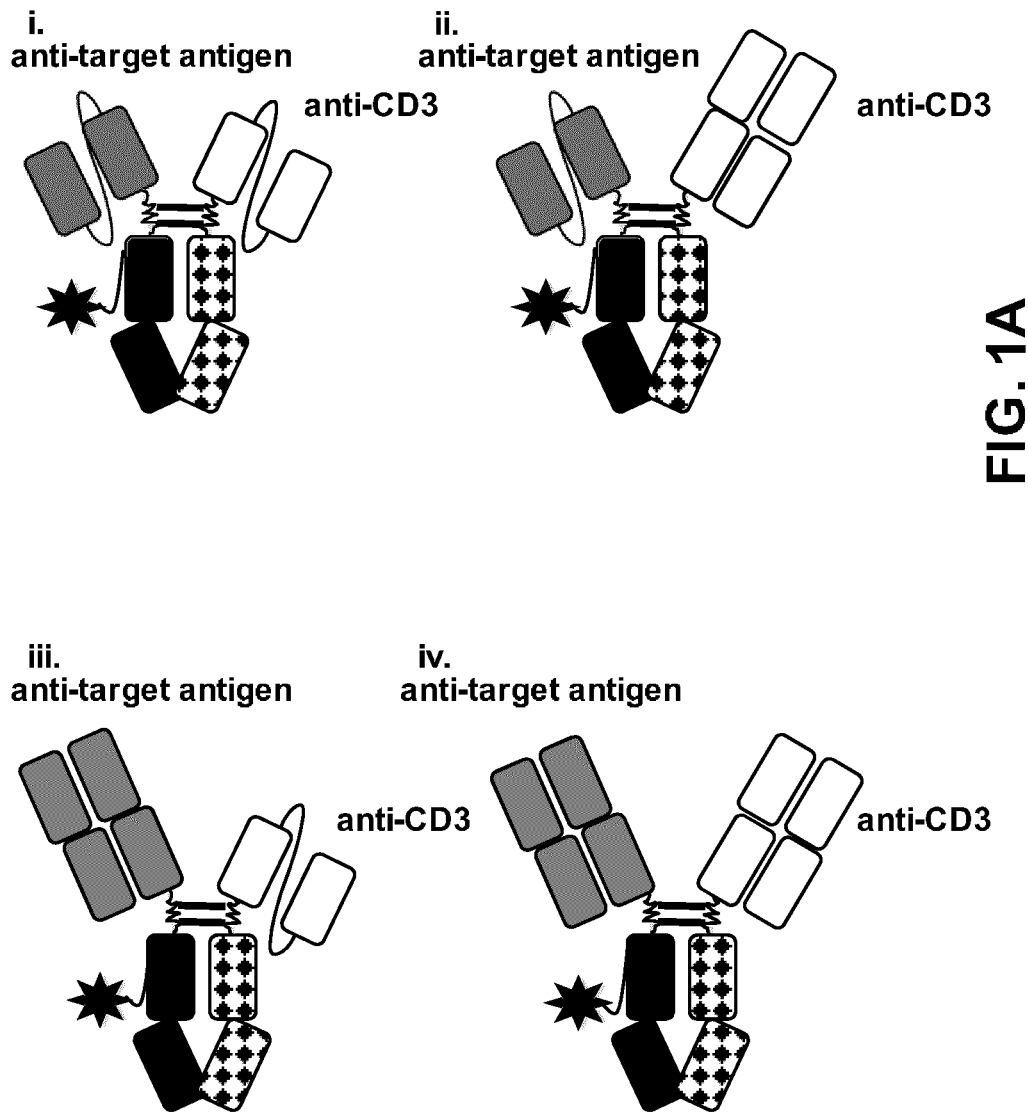
FIG. 1A depicts schematic representations of designs of antigen-binding constructs conjugated to a drug, the drug being depicted by a "star". One binding domain of the antigen-binding constructs binds to a CD3 antigen, and the other binding domain binds to a "target antigen" expressed on a cell surface of a target cell. Although there is only one "star", the construct may contain multiple drug molecules which can be the same, or different.
Figure 1B:
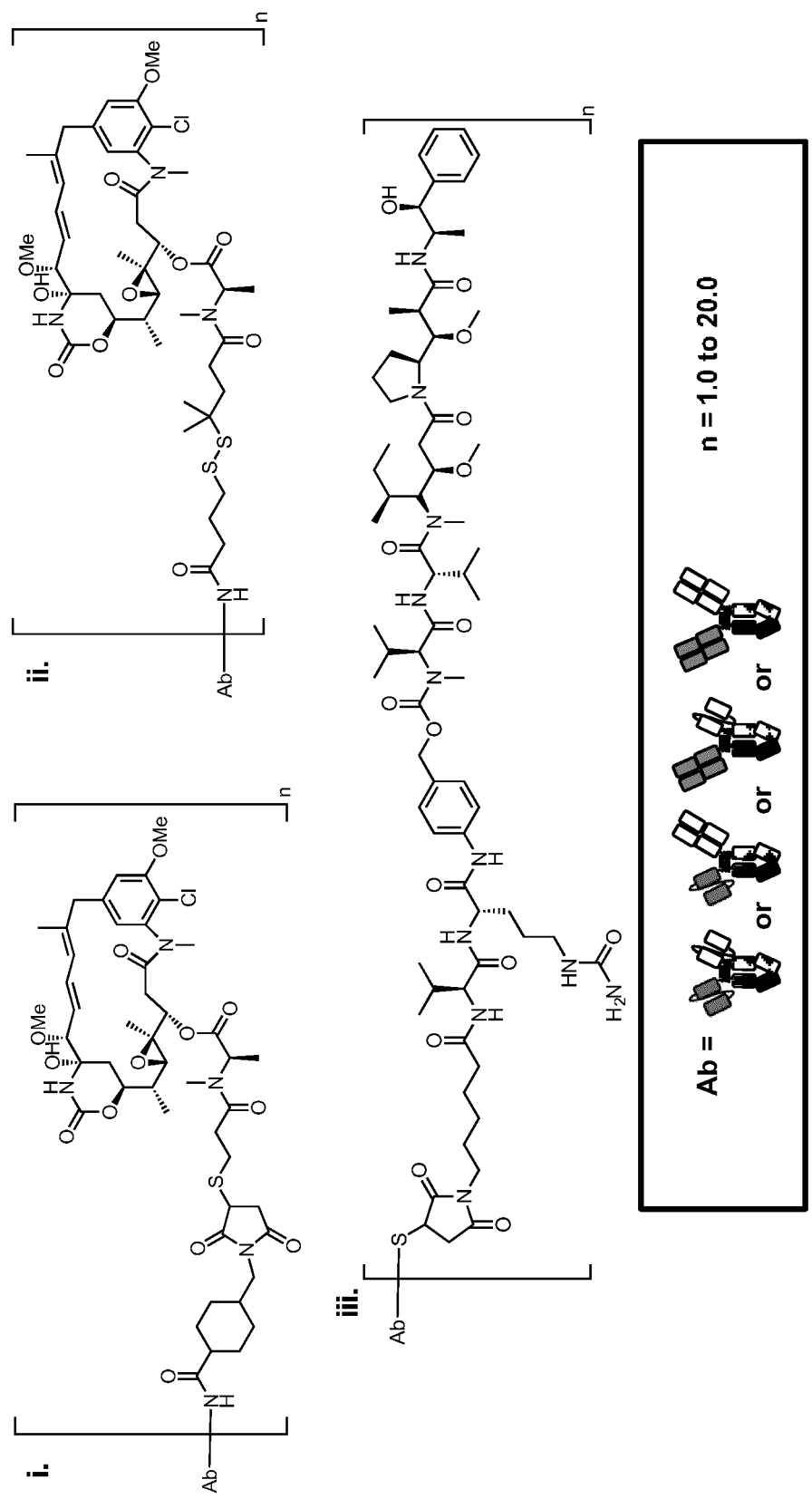
FIG. 1B depicts exemplary embodiments of antigen binding construct drug conjugates (ADCs).

Described herein are drug-conjugated bispecific antigen-binding constructs e.g. antibodies, often termed antibody-drug conjugates or ADCs. Provided herein are drug-conjugated antigen-binding constructs that bind to a CD3 antigen expressed on T cells and to a second target antigen expressed on the surface of a target cell, for example a tumor cell, a cell responsible for autoimmunity or a cell infected with a pathogen. These drug-conjugated antigen-binding constructs comprise a first antigen-binding domain that specifically binds to the CD3 antigen expressed on T cells, and a second antigen-binding domain that specifically binds to another target antigen expressed on a the surface of a target cell, and at least one drug molecule conjugated to the antigen-binding construct. The first and second antigen-binding domains may be operably linked to each other, or they may each be linked to a scaffold, such as an Fc domain, as further described herein.

Certain exemplary bispecific antigen-binding constructs used herein to produce ADCs have been shown elsewhere to be able to bridge CD3-expressing T cells with CD19-expressing B cells, with the formation of immunological synapses. These antigen-binding constructs were able to mediate T cell-directed B cell depletion as measured by in vitro and ex vivo assays, and as assessed in an in vivo model of disease.

In some embodiments described herein anti-CD3-target antigen drug-conjugated antigen-binding constructs are shown to exhibit higher killing potency in depleting target tumor cells in vitro than the same antigen-binding construct that does not comprise a drug. Unexpectedly, several exemplary CD3-target antigen drug-conjugated antigen-binding constructs are shown herein to exhibit high killing potency against target antigen-expressing tumor cells in vitro while at the same time exhibiting low potency against T cells. Additionally, in some embodiments, these ADCs are shown not to significantly deplete circulating T cells in vivo in humanized mice when administered at doses up to 3 mg/kg. In view of the lack of impact on T cells, and without being bound by theory, it appears that CD3-target antigen drug-conjugated antigen-binding constructs may exert their effect on target cells through two distinct mechanisms: T cell-mediated killing, and toxin/small molecule-mediated killing resulting from internalization of the CD3-target antigen drug-conjugated antigen-binding constructs. Hence the anti-CD3-target antigen drug-conjugated antigen-binding constructs described herein may have an added benefit in the treatment of diseases such as cancer over conventional T-cell engager therapeutics, none of which, to our knowledge, have incorporated a toxin or other drug. Additionally the drug-conjugated bispecific antigen-binding constructs that comprise antigen binding domains for CD3 and target antigens have potential in treating diseases other than cancer, such as autoimmune or inflammatory diseases and diseases caused by intracellular pathogens, by combining the mechanisms of T cell- and drug-mediated killing.

Also described are pharmaceutical compositions comprising the drug-conjugated antigen-binding constructs and methods of treating a disease, disorder or condition e.g., cancer, using the drug-conjugated antigen-binding constructs described herein.

Described herein are drug-conjugated antigen-binding constructs comprising a first antigen-binding polypeptide construct that specifically binds a CD3 antigen expressed on T cells, and a second antigen-binding polypeptide construct which and specifically binds a target antigen, such as a tumor antigen expressed on the surface of tumor cells. The first and second antigen-binding polypeptide constructs are operably linked, and the antigen-binding construct is conjugated to a drug. The drug-conjugated antigen-binding construct displays higher killing potency against target cells bearing the target antigen in vitro than a reference antigen-binding construct that is not conjugated to a drug.

The antigen-binding polypeptide constructs may have different formats. In some embodiments, the first and second antigen-binding polypeptides each comprise a Fab or an scFv. In some embodiments the first antigen-binding polypeptide construct is a Fab and the second antigen-binding polypeptide is an scFv. In some embodiments the first antigen-binding polypeptide construct is a scFv and the second antigen-binding polypeptide is an scFv. In other embodiments, the first and second antigen-binding polypeptide constructs may both comprise Fabs or may both comprise scFvs. In certain embodiments, the CD3-binding polypeptide construct is an scFv and the target antigen-binding construct is a Fab.

In some embodiments, the drug-conjugated antigen-binding construct further comprises an heterodimeric Fc, with a first Fc polypeptide linked to the first antigen-binding polypeptide construct with or without a first linker and a second Fc polypeptide linked to the second antigen-binding polypeptide construct with or without a second linker. As described in detail below, in some embodiments, the heterodimeric Fc comprises a modified CH3 domain comprising asymmetric amino acid modifications that promote the formation of the heterodimeric Fc and the dimerized CH3 domains having a melting temperature (Tm) of about 68° C. or higher. In some embodiments, the asymmetric amino acid modifications are selected from Table C below.

In some embodiments, the second antigen-binding polypeptide construct comprises the antigen-binding polypeptide construct specific for CD3 derived from an antibody selected from OKT3; Teplizumab™ (MGA031, Eli Lilly); blinatumomab; UCHT1; NI0401; visilizumab; X35-3, VIT3, BMA030 (BW264/56), CLB-T3/3, CRIS7, YTH12.5, F111-409, CLB-T3.4.2, WT31, WT32, SPv-T3b, 11D8, XIII-141, XIII-46, XIII-87, 12F6, T3/RW2-8C8, T3/RW2-4B6, OKT3D, M-T301, SP34, SMC2 and F101.01; or a humanized version thereof. Other CD3 binding moieties are possible, and may be made by methods described herein. In some embodiments, the antigen-binding polypeptide construct has the 6 CDRs of wild-type OKT3, or the 6 CDRs of the stabilized variant of OKT3, or a humanized variant of OKT3 in Table S1.

In some embodiments described herein, the target antigen (cognate antigen-for the second antigen-binding polypeptide construct) is a B cell antigen. In some embodiments, the target antigen is CD19. Thus in some embodiments wherein the tumor antigen is CD19, the second antigen-binding polypeptide construct has the 6 CDRs of HD37 or the humanized variants of HD37 as shown in Table S1. In some embodiments, the second antigen-binding polypeptide construct comprises the antigen-binding polypeptide construct specific for CD19 derived from an antibody selected from the group consisting of 4G7; B4; B43; BU12; CLB-CD19; Leu-12; SJ25-C1; J4.119, B43, SJ25C1, FMC63 (IgG2a) HD237 (IgG2b), Mor-208, MEDI-551, and MDX-1342.

In other embodiments, the drug-conjugated antigen binding construct may be any of variants 6754, 6751, 1853, 10151, 6475, 6749, 10152, 10153, 6476, 5850, 5851, 5852, 6325, 1661, 1653, 1662, 1660, 1666, 1801, 6747, 10149, 10150, 1380 or 12043, 151912, 15193, 15194, 15195, 17118 or 17119, conjugated to a drug.

In many embodiments of drug-conjugated antigen-binding construct having Fcs, there are modifications in the CH2 domain to reduce or eliminate Fc gamma receptor binding and thus they have no associated immune-cell mediated effector activity.

In some embodiments of a drug-conjugated antigen-binding construct, the affinity for the first antigen-binding polypeptide construct for CD3 is at least 2, 5, 10, 15 or 20-fold lower than and the affinity of the second antigen-binding polypeptide construct for the target antigen, as determined by SPR or FACS analysis.

Also provided is a method of treating a disease, disorder or condition in a subject, the method comprising administering an effective amount of the drug-conjugated antigen-binding construct of to the subject. In some embodiments, the cancer is a hematopoietic cancer, leukemia, a lymphoma, a hematological cancer, a B-cell lymphoma, a non-Hodgkin's lymphoma, a cancer non-responsive to at least one of a CD19 lytic antibody, a CD20 lytic antibody and blinatumomab, a cancer cell regressive after treatment with blinatumomab, ALL, CLL, NHL, Mantle Cell Lymphoma, disseminated B cell diseases and metastases of the brain, lung, liver, and/or bone. In some embodiments, the tumor is a solid tumor.

Also provided is a method of depleting target cells in a subject comprising administering to the subject an effective amount of a drug-conjugated antigen-binding polypeptide construct comprising a first antigen-binding polypeptide construct that monovalently and specifically binds to a CD3 antigen expressed on T cells of the subject and a second antigen-binding polypeptide construct that specifically binds to an antigen expressed on the target cells, wherein the first and second antigen-binding polypeptide constructs are operably linked, and wherein the antigen-binding construct is conjugated to a drug. In some embodiments, the tumor cells in the subject are depleted, but the T cells are not substantially depleted. In some embodiments, the administration does not result in up-regulation of PD-1+(inhibitory) T cells in the subject.

Bi-Specific Antigen-Binding Constructs for Drug Conjugation

Provided herein are drug-conjugates of bi-specific antigen-binding constructs, e.g., antibodies, that bind CD3 and a second antigen expressed on target cells. The antigen-binding construct itself comprises two antigen-binding polypeptide constructs, e.g., antigen binding domains specifically binding either CD3 or the target antigen. In some embodiments, the target antigen is associated with a tumor, for example CD19, HER2, HER3, CDH3, or EGFR. In some embodiments, the antigen-binding construct is derived from known antibodies or antigen-binding constructs. As described in more detail below, the antigen-binding polypeptide constructs may have the format of a Fab or an scFv (single chain Fv) and may include an Fc.

In some embodiments, first antigen-binding polypeptide construct (anti-CD3) may comprise a second scFv comprising a second VL, a second scFv linker, and a second VH or it may comprise a Fab comprising a second VL and a second VH. The second scFv may be selected from the group consisting of the OKT3 scFv, a modified OKT3 scFv, an OKT3 blocking antibody scFv, and a modified OKT3 blocking antibody scFv, wherein the OKT3 blocking antibody blocks by 50% or greater the binding of OKT3 to the epsilon subunit of the CD3 antigen. The second antigen-binding polypeptide construct may comprise the antigen-binding polypeptide construct specific for CD3 derived from an antibody selected from OKT3; Teplizumab™ (MGA031, Eli Lilly); Micromet, blinatumomab; UCHT1; NI0401; visilizumab; X35-3, VIT3, BMA030 (BW264/56), CLB-T3/3, CRIS7, YTH12.5, F111-409, CLB-T3.4.2, WT31, WT32, SPv-T3b, 11D8, XIII-141, XIII-46, XIII-87, 12F6, T3/RW2-8C8, T3/RW2-4B6, OKT3D, M-T301, SMC2, F101.01 or SP34.

In some embodiments, for example, the second antigen-binding polypeptide construct (anti-CD19) may comprise an scFv comprising a first VL, a first scFv linker, and a first VH or it may comprise a Fab comprising a first VL and a first VH. The first scFv may be selected from the group consisting of an anti-CD19 antibody HD37 scFv, a modified HD37 scFv, an HD37 blocking antibody scFv, and a modified HD37 blocking antibody scFv, wherein the HD37 blocking antibody blocks by 50% or greater the binding of HD37 to the CD19 antigen. Alternatively, antigen-binding polypeptide constructs (anti-CD19) may comprise the corresponding Fabs. The first antigen-binding polypeptide construct may comprise the antigen-binding polypeptide construct specific for CD19 derived from an antibody selected from the group consisting of 4G7; B4; B43; BU12; CLB-CD19; Leu-12; SJ25-C1; J4.119, B43, SJ25C1, FMC63 (IgG2a) HD237 (IgG2b), Mor-208, MEDI-551, or MDX-1342.

The heterodimeric Fc comprises first and second Fc polypeptides each comprising a modified CH3 sequence capable of forming a dimerized CH3 domain, wherein each modified CH3 sequence comprises asymmetric amino acid modifications that promote formation of a heterodimeric Fc and the dimerized CH3 domains have a melting temperature (Tm) of about 68° C. or higher. The first Fc polypeptide is linked to the first antigen-binding polypeptide construct with a first hinge linker, and the second Fc polypeptide is linked to the second antigen-binding polypeptide construct with a second hinge linker. In some embodiments, and as described below, the CH2 domain of the Fc is modified to reduce or eliminate binding of the drug-conjugated antigen-binding constructs to Fc receptors.

The term "antigen-binding construct" refers to any agent, e.g., polypeptide or polypeptide complex capable of binding to an antigen. In some aspects an antigen-binding construct is a polypeptide that specifically binds to an antigen of interest. An antigen-binding construct can be a monomer, dimer, multimer, a protein, a peptide, or a protein or peptide complex; an antibody, an antibody fragment, or an antigen-binding fragment thereof; an scFv and the like. An antigen-binding construct can be a polypeptide construct that is monospecific, bi-specific, or multispecific. In some aspects, an antigen-binding construct can include, e.g., one or more antigen-binding components (e.g., Fabs or scFvs) linked to one or more Fc. Further examples of antigen-binding constructs suitable for use in ADCs are described below and provided in the Examples.

The term "bi-specific" is intended to include any agent, e.g., an antigen-binding construct, which has two antigenbinding moieties (e.g. antigen-binding polypeptide constructs), each with a unique binding specificity. For example, a first antigen-binding moiety binds to an epitope on a first antigen, and a second antigen-binding moiety binds to an epitope on a second antigen, where the first antigen is different from the second antigen.

For example, in some embodiments a bi-specific agent may bind to, or interact with, (a) a cell surface target molecule and (b) an Fc receptor on the surface of an effector cell. In another embodiment, the agent may bind to, or interact with (a) a first cell surface target molecule and (b) a second cell surface target molecule that is different from the first cells surface target molecule. In another embodiment, the agent may bind to and bridge two cells, i.e. interact with (a) a first cell surface target molecule on a first call and (b) a second cell surface target molecule on a second cell that is different from the first cell's surface target molecule.

In some embodiments, the bi-specific antigen-binding construct bridges CD3-expressing T cells with CD19-expressing B cells, with the formation of immunological synapses and/or mediation of T cell directed B cell depletion.

A monospecific antigen-binding construct refers to an antigen-binding construct with a single binding specificity. In other words, both antigen-binding moieties bind to the same epitope on the same antigen. Examples of monospecific antigen-binding constructs include the anti-CD19 antibody HD37 and the anti-CD3 antibody OKT3.

An antigen-binding construct can be an antibody or antigen-binding portion thereof. As used herein, an "antibody" or "immunoglobulin" refers to a polypeptide substantially encoded by an immunoglobulin gene or immunoglobulin genes, or fragments thereof, which specifically bind and recognize an analyte (e.g., antigen). The recognized immunoglobulin genes include the kappa, lambda, alpha, gamma, delta, epsilon and mu constant region genes, as well as the myriad immunoglobulin variable region genes. Light chains are classified as either kappa or lambda. The "class" of an antibody or immunoglobulin refers to the type of constant domain or constant region possessed by its heavy chain. There are five major classes of antibodies: IgA, IgD, IgE, IgG, and IgM, and several of these may be further divided into subclasses (isotypes), e.g., IgG1, IgG2, IgG3, IgG4, IgA1, and IgA2. The heavy chain constant domains that correspond to the different classes of immunoglobulins are called α, δ, ε, γ, and μ, respectively.

An exemplary immunoglobulin (antibody) structural unit is composed of two pairs of polypeptide chains, each pair having one "light" (about 25 kD) and one "heavy" chain (about 50-70 kD). The N-terminal domain of each chain defines a variable region of about 100 to 110 or more amino acids primarily responsible for antigen recognition. The terms variable light chain (VL) and variable heavy chain (VH) refer to these light and heavy chain domains respectively.

The $IgG_1$ heavy chain comprised of the VH, CH1, CH2 and CH3 domains respectively from the N to C-terminus. The light chain is comprised of the VL and CL domains from N to C terminus. The $IgG_1$ heavy chain comprises a hinge between the CH1 and CH2 domains.

The term "hypervariable region" or "HVR", as used herein, refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the complementarity determining regions (CDRs), the latter being of highest sequence variability and/or involved in antigen recognition. With the exception of CDR1 in VH, CDRs generally comprise the amino acid residues that form the hypervariable loops. Hypervariable regions (HVRs) are also referred to as "complementarity determining regions" (CDRs), and these terms are used herein interchangeably in reference to portions of the variable region that form the antigen-binding regions. This particular region has been described by Kabat et al., U.S. Dept. of Health and Human Services, Sequences of Proteins of Immunological Interest (1983) and by Chothia et al., J Mol Biol 196:901-917 (1987), where the definitions include overlapping or subsets of amino acid residues when compared against each other. Nevertheless, application of either definition to refer to a CDR of an antibody or variants thereof is intended to be within the scope of the term as defined and used herein. The exact residue numbers which encompass a particular CDR will vary depending on the sequence and size of the CDR. Those skilled in the art can routinely determine which residues comprise a particular CDR given the variable region amino acid sequence of the antibody.

The CDR regions of an antibody may be used to construct a binding protein, including without limitation, an antibody, a scFv, a diabody, and the like. In a certain embodiment, the antigen-binding constructs described herein will comprise at least one or all the CDR regions from an antibody. CDR sequences may be used on an antibody backbone, or fragment thereof, and likewise may include humanized antibodies, or antibodies containing humanized sequences. Methods of identifying CDR portions of an antibody are well known in the art. See, Shirai, H., Kidera, A., and Nakamura, H., H3-rules: Identification of CDR-H3 structures in antibodies, FEBS Lett., 455(1):188-197, 1999; and Almagro J C, Fransson, J. Front Biosci. 13:1619-33 (2008).

Antigen-Binding Polypeptide Construct—Format

The bi-specific antigen-binding construct comprises two antigen-binding polypeptide constructs, e.g., antigen binding domains. The format of the antigen-binding polypeptide construct determines the functional characteristics of the bi-specific antigen-binding construct. In one embodiment, the bi-specific antigen-binding construct has an scFv-scFv format, i.e. both antigen-binding polypeptide constructs are scFvs. In another embodiment the antigen-binding construct has an scFv-Fab format. In another embodiment, both antigen-binding polypeptide constructs are Fabs.

The format "Single-chain Fv" or "scFv" includes the VH and VL domains of an antibody, wherein these domains are present in a single polypeptide chain. In some embodiments, the scFv polypeptide further comprises a polypeptide linker between the VH and VL domains. For a review of scFv see Pluckthun in *The Pharmacology of Monoclonal Antibodies*, vol. 113, Rosenburg and Moore eds., Springer-Verlag, New York, pp. 269-315 (1994).

Other antigen-binding polypeptide construct formats include a Fab fragment or sdAb.

The "Fab fragment" (also referred to as fragment antigen-binding) contains the constant domain (CL) of the light chain and the first constant domain (CH1) of the heavy chain along with the variable domains VL and VH on the light and heavy chains respectively. The variable domains comprise the complementarity determining loops (CDR, also referred to as hypervariable region) that are involved in antigen-binding. Fab' fragments differ from Fab fragments by the addition of a few residues at the carboxy terminus of the heavy chain CH1 domain including one or more cysteines from the antibody hinge region.

The "Single domain antibodies" or "sdAb" format is an individual immunoglobulin domain. Sdabs are fairly stable and easy to express as fusion partner with the Fc chain of an antibody (Harmsen M M, De Haard H J (2007). "Properties, production, and applications of camelid single-domain antibody fragments". Appl. Microbiol Biotechnol. 77(1): 13-22). In some embodiments an antigen-binding construct provided herein comprises an antigen-binding polypeptide construct that lacks a light chain, thus comprising a single domain antibody.

scFv Format

The antigen-binding constructs described herein are bi-specific, e.g., they comprise two antigen-binding polypeptide constructs each capable of specific binding to a distinct antigen. In some embodiments, either or both antigen-binding polypeptide construct is in an scFv format. (i.e., antigen-binding domains composed of a heavy chain variable domain and a light chain variable domain, connected with a polypeptide linker). In one embodiment said scFv are human. In another embodiment said scFv molecules are humanized. The scFvs are optimized for protein expression and yield by the modifications described below.

The scFv can be optimized by changing the order of the variable domains VL and VH in the scFv. In some embodiments of an scFv in a antigen-binding construct described herein, the C-terminus of the light chain variable region may be connected to the N-terminus of the heavy chain variable region, or the C-terminus of the heavy chain variable region may be connected to the N-terminus of the light chain variable region.

The variable regions may be connected via a linker peptide, or scFv linker, that allows the formation of a functional antigen-binding moiety. The scFv can be optimized for protein expression and yield by changing composition and/or length of the scFv linker polypeptide. Typical peptide linkers comprise about 2-20 amino acids, and are described herein or known in the art. Suitable, non-immunogenic linker peptides include, for example, $(G_4S)_n$ (SEQ ID NO: 1083), $(SG_4)_n$ (SEQ ID NO: 1084), $(G_4S)_n$ (SEQ ID NO: 1083), $G_4(SG_4)_n$ (SEQ ID NO: 1085) or $G_2(SG_2)_n$ (SEQ ID NO: 1086) linker peptides, wherein n is generally a number between 1 and 10, typically between 2 and 4.

In some embodiments, the scFv linker is selected from Table below:

TABLE A

| scFv linker polypeptide sequences |
|---|
| CD19 |
| GGGGSGGGGSGGGGS (SEQ ID NO: 1087) |
| CD3 |
| GGGGSGGGGSGGGGS (SEQ ID NO: 1087) |
| SSTGGGGSGGGGSGGGGSDI (SEQ ID NO: 1088) |
| VEGGSGGSGGSGGSGGVD (SEQ ID NO: 1089) |
| Generic linkers: |
| GGGGSGGGGSGGGGS (SEQ ID NO: 1087) |
| GGGGSGGGGSGGGGSGGGGS (SEQ ID NO: 1090) |

TABLE A-continued

| scFv linker polypeptide sequences |
|---|
| GSTSGGGSGGGSGGGGSS (SEQ ID NO: 1091) |
| GSTSGSGKPGSGEGSTKG (SEQ ID NO: 1092) |

The scFv molecule may be optimized for protein expression and yield by including stabilizing disulfide bridges between the heavy and light chain variable domains, for example as described in Reiter et al. (Nat Biotechnol 14, 1239-1245 (1996)). Hence, in one embodiment the T cell activating bi-specific antigen-binding molecule of the invention comprises a scFv molecule wherein an amino acid in the heavy chain variable domain and an amino acid in the light chain variable domain have been replaced by cysteine so that a disulfide bridge can be formed between the heavy and light chain variable domain. In a specific embodiment the amino acid at position 44 of the light chain variable domain and the amino acid at position 100 of the heavy chain variable domain have been replaced by cysteine (Kabat numbering).

As is known in the art, scFvs can also be stabilized by mutation of CDR sequences, as described in [Miller et al., Protein Eng Des Sel. 2010 July; 23(7):549-57; Igawa et al., MAbs. 2011 May-June; 3(3):243-5; Perchiacca & Tessier, Annu Rev Chem Biomol Eng. 2012; 3:263-861 One or more of the above noted modifications to the format and sequence of the scFv may be applied to scFvs of the antigen-binding constructs.

Humanized CD19 VH and VL

In some embodiments, and in order to further stabilize the antigen-binding constructs described herein, the wild-type sequences of the HD37 anti-CD19 antibody can be modified to generate humanized VH and VL polypeptide sequences. Modifications to both the framework regions and CDRs can be made in order to obtain VH and VL polypeptide sequences to be used in the CD19-binding scFvs and Fabs of the antigen-binding constructs. In some embodiments, the modifications are those depicted in FIG. 2. In some embodiments, the Tm of a humanized anti-CD19 binding domain is higher than the Tm of an HD37 binding domain. In some embodiments, the Tm of a humanized anti-CD19 binding domain is at least 2, at least 3, at least 4, at least 5, at least 6, at least 7, at least 8, at least 10 degrees C. higher than the Tm of an HD37 binding domain.

Humanized CD3 VH and VL

In some embodiments, and in order to further stabilize the antigen-binding constructs described herein the wild-type sequences of the OKT3 anti-CDS3 antibody are modified to generate humanized VH and VL polypeptide sequences. Modifications to both the framework regions and CDRs can be made in order to obtain VH and VL polypeptide sequences to be used in the CD3-binding scFvs and Fabs of the antigen-binding constructs. In some embodiments, the modifications are those depicted in FIG. 4. In some embodiments, the Tm of a humanized anti-CD19 scFv binding domain is higher than the Tm of an OKT3 or teplizumab binding domain. In some embodiments, the Tm of a humanized anti-CD19 scFv binding domain is at least 2, at least 3, at least 4, at least 5, at least 6, at least 7, at least 8, at least 10 degrees C. higher than the Tm of an OKT3 or teplizumab binding domain.

Antigen-Binding Polypeptide Construct—Antigens

The antigen-binding constructs described herein specifically bind a CD3 antigen and a second target antigen.

As used herein, the term "antigenic determinant" is synonymous with "antigen" and "epitope," and refers to a site (e.g. a contiguous stretch of amino acids or a conformational configuration made up of different regions of non-contiguous amino acids) on a polypeptide macromolecule to which an antigen-binding moiety binds, forming an antigen-binding moiety-antigen complex. An epitope typically includes at least 3, and more usually, at least 5 or 8-10 amino acids in a unique spatial conformation. The epitope may comprise amino acid residues directly involved in the binding and other amino acid residues, which are not directly involved in the binding, such as amino acid residues which are effectively blocked by the specifically antigen binding peptide; in other words, the amino acid residue is within the footprint of the specifically antigen binding peptide. Antibodies that recognize the same epitope can be verified in a simple immunoassay showing the ability of one antibody to block the binding of another antibody to a target antigen.

"Specifically binds", "specific binding" or "selective binding" means that the binding is selective for the antigen and can be discriminated from unwanted or non-specific interactions. The ability of an antigen-binding construct to bind to a specific antigenic determinant can be measured either through an enzyme-linked immunosorbent assay (ELISA) or other techniques familiar to one of skill in the art, e.g. surface plasmon resonance (SPR) technique (analyzed on a BIAcore instrument) (Liljeblad et al, Glyco J 17, 323-329 (2000)), and traditional binding assays (Heeley, Endocr Res 28, 217-229 (2002)). In one embodiment, the extent of binding of an antigen-binding moiety to an unrelated protein is less than about 10% of the binding of the antigen-binding construct to the antigen as measured, e.g., by SPR.

In certain embodiments, an antigen-binding construct that binds to the antigen, or an antigen-binding molecule comprising that antigen-binding moiety, has a dissociation constant (KD) of <1 µM, <100 nM, <10 nM, <1 nM, <0.1 nM, <0.01 nM, or <0.001 nM (e.g. $10^{-8}$M or less, e.g. from $10^{-8}$ M to $10^{-13}$M, e.g., from $10^{-9}$ M to $10^{-13}$ M).

"Affinity" refers to the strength of the sum total of non-covalent interactions between a single binding site of a molecule (e.g., a receptor) and its binding partner (e.g., a ligand). Unless indicated otherwise, as used herein, "binding affinity" refers to intrinsic binding affinity which reflects a 1:1 interaction between members of a binding pair (e.g., an antigen-binding moiety and an antigen, or a receptor and its ligand). The affinity of a molecule X for its partner Y can generally be represented by the dissociation constant ($K_D$), which is the ratio of dissociation and association rate constants ($k_{off}$ and $k_{on}$, respectively). Thus, equivalent affinities may comprise different rate constants, as long as the ratio of the rate constants remains the same. Affinity can be measured by well established methods known in the art, including those described herein. A particular method for measuring affinity is Surface Plasmon Resonance (SPR), or whole cell binding assays with cells that express the antigen of interest.

"Reduced binding", for example reduced binding to an Fc receptor, refers to a decrease in affinity for the respective interaction, as measured for example by SPR. For clarity the term includes also reduction of the affinity to zero (or below the detection limit of the analytic method), i.e. complete abolishment of the interaction. Conversely, "increased binding" refers to an increase in binding affinity for the respective interaction.

An "activating T cell antigen" as used herein refers to an antigenic determinant expressed on the surface of a T lymphocyte, particularly a cytotoxic T lymphocyte, which is capable of inducing T cell activation upon interaction with an antigen-binding molecule. Specifically, interaction of an antigen-binding molecule with an activating T cell antigen may induce T cell activation by triggering the signaling cascade of the T cell receptor complex. In a particular embodiment the activating T cell antigen is CD3.

"T cell activation" as used herein refers to one or more cellular response of a T lymphocyte, particularly a cytotoxic T lymphocyte, selected from: proliferation, differentiation, cytokine secretion, cytotoxic effector molecule release, cytotoxic activity, and expression of activation markers. The T cell activating bi-specific antigen-binding molecules of the invention are capable of inducing T cell activation. Suitable assays to measure T cell activation are known in the art described herein.

A "target cell antigen" or "target antigen" as used herein refers to an antigenic determinant presented on the surface of a target cell, for example a B cell in a tumor such as a cancer cell or a cell of the tumor stroma. A tumor antigen is a target cell antigen expressed on a tumor cell. In some embodiments, a tumor antigen or may be overexpressed on tumor cells. As used herein, the terms "first" and "second" with respect to antigen-binding moieties etc., are used for convenience of distinguishing when there is more than one of each type of moiety. Use of these terms is not intended to confer a specific order or orientation of the T cell activating bi-specific antigen-binding molecule unless explicitly so stated.

The term "cross-species binding" or "interspecies binding" or "species cross-reactive" as used herein means binding of a binding domain described herein to the same target molecule in humans and other organisms for instance, but not restricted to non-chimpanzee primates. Thus, "cross-species binding" or "interspecies binding" is to be understood as an interspecies reactivity to the same molecule "X" (i.e. the homolog) expressed in different species, but not to a molecule other than "X". Cross-species specificity of a monoclonal antibody recognizing e.g. human CD3 epsilon, to a non-chimpanzee primate CD3 epsilon, e.g. macaque CD3 epsilon, can be determined, for instance, by FACS analysis. The FACS analysis is carried out in a way that the respective monoclonal antibody is tested for binding to human and non-chimpanzee primate cells, e.g. macaque cells, expressing said human and non-chimpanzee primate CD3 epsilon antigens, respectively. An appropriate assay is shown in the following examples. The above-mentioned subject matter applies mutatis mutandis for the CD19. The FACS analysis is carried out in a way that the respective monoclonal antibody is tested for binding to human and non-chimpanzee primate cells, e.g. macaque cells, expressing said human and non-chimpanzee primate CD3 or CD19 antigens.

CD3

The antigen-binding constructs described herein specifically bind a CD3 antigen.

"CD3" or "CD3 complex" as described herein is a complex of at least five membrane-bound polypeptides in mature T-lymphocytes that are non-covalently associated with one another and with the T-cell receptor. The CD3 complex includes the gamma, delta, epsilon, and zeta chains (also referred to as subunits). Non-human monoclonal antibodies have been developed against some of these chains, as exemplified by the murine antibodies OKT3, SP34, UCHT1 or 64.1. (See e.g., June, et al., J. Immunol. 136:3945-3952 (1986); Yang, et al., J. Immunol. 137:1097-1100 (1986); and Hayward, et al., Immunol. 64:87-92 (1988)). Clustering of CD3 on T cells, e.g., by immobilized anti-CD3-antibodies, leads to T cell activation similar to the engagement of the T cell receptor but independent from its clone typical specificity. Most anti-CD3-antibodies recognize the CD3ε-chain.

In some embodiments, the anti-CD3 scFv or Fab is an scFV or Fab of a known anti-CD3 antibody, or is derived from, e.g., is a modified version of the scFv or Fab of a known anti-CD3 antibody. Antibodies directed against human CD3 which provide for variable regions (VH and VL) to be employed in the bi-specific antigen-binding construct described herein are known in the art and include OKT3 (ORTHOCLONE-OKT3™ (muromonab-CD3). Additional anti-CD3 antibodies include "OKT3 blocking antibodies" that block by 50% or greater the binding of OKT3 to the epsilon subunit of the CD3 antigen. Examples include but are not limited to Teplizumab™ (MGA031, Eli Lilly); UCHT1 (Pollard et al. 1987 J Histochem Cytochem. 35(11):1329-38); NI0401 (WO2007/033230); and visilizumab (US25834597).

In one embodiment, the bi-specific antigen-binding construct comprises a CD3 antigen-binding polypeptide construct which monovalently and specifically binds a CD3 antigen, where the CD3 antigen-binding polypeptide construct is derived from OKT3 (ORTHOCLONE-OKT3™ (muromonab-CD3). In one embodiment the bi-specific antigen-binding construct comprises a CD3 antigen-binding polypeptide construct which monovalently and specifically binds a CD3 antigen, the VH and VL regions of said CD3 antigen-binding polypeptide derived from the CD3 epsilon-specific antibody OKT3.

In some embodiments, the binding affinity of the first antigen binding polypeptide construct specific for the epsilon subunit of CD3 is between about 1 nM to about 100 nM, or between about 20 nM to about 100 nM, or, e.g., greater than 2, 3, 4, 5, 6, 7, 8, 9, 10, 20, 30, 40, 50, 60, 70, 80, or greater than 90 nM.

The epitope on the CD3 epsilon subunit to which the OKT3 antibody binds is identified by analysis of the crystal structure of the OKT3 bound to CD3 epsilon (Kjer-Nielsen L. et al., (2004) Proc. Natl. Acad. Sci. USA 101: 7675-7680). The polypeptide sequence of CD3 epsilon is provided in the Table below.

TABLE B

| CD3 Epsilon sequence | |
|---|---|
| Human T-cell surface glycoprotein CD3 epsilon subunit, UniProt ID: P07766 (207 amino acids) | MQSGTHWRVLGLCLLSVGVWGQDGNEEMGGI TQTPYKVSISGTTVILTCPQYPGSEILWQHN DKNIGGDEDDKNIGSDEDHLSLKEFSELEQS GYYVCYPRGSKPEDANFYLYLRARVCENCME MDVMSVATIVIVDICITGLLLLVYYWSKNR KAKAKPVTRGAGAGGRQRGQNKERPPPVPNP DYEPIRKGQRDLYSGLNQRRI (SEQ ID NO: 1093) |

Analysis of this structure indicates that the CDRs of the OKT3 antibody, with respect to the sequence in Table B, contact human CD3 epsilon at residues 56-57 (SE), 68-70 (G DE), and 101-107 (RGSKPED) (SEQ ID NO: 1094). The binding hotspots in these residues are underlined. These residues are considered to be the epitope to which OKT3 binds. Accordingly, the antigen-binding constructs described herein may comprise an antigen-binding polypeptide construct that specifically binds to this epitope.

Provided herein are antigen-binding constructs comprising at least one CD3 binding polypeptide construct that binds to a CD3 complex on at least one CD3 expressing cell, where in the CD3 expressing cell is a T-cell. In certain embodiments, the CD3 expressing cell is a human cell. In some embodiments, the CD3 expressing cell is a non-human, mammalian cell. In some embodiments, the T cell is a cytotoxic T cell. In some embodiments the T cell is a CD4+ or a CD8+ T cell.

In certain embodiments of the antigen-binding constructs provided herein, the construct is capable of activating and redirecting cytotoxic activity of a T cell to a target cell such as a B cell. In a particular embodiment, said redirection is independent of MHC-mediated peptide antigen presentation by the target cell and/or specificity of the T cell.

Target Antigens

CD19

B-cell antigen CD 19 (CD 19, also known as B-cell surface antigen B4, Leu-12; Uniprot ID #P15391) is a human pan-B-cell surface marker that is expressed from early stages of pre-B cell development through terminal differentiation into plasma cells. CD 19 promotes the proliferation and survival of mature B cells. It associates in a complex with CD21 on the cell surface. It also associates with CD81 and Leu-13 and potentiates B cell receptor (BCR) signaling. Together with the BCR, CD 19 modulates intrinsic and antigen receptor-induced signaling thresholds critical for clonal expansion of B cells and humoral immunity. In collaboration with CD21 it links the adaptive and the innate immune system. Upon activation, the cytoplasmic tail of CD 19 becomes phosphorylated which leads to binding by Src-family kinases and recruitment of PI-3 kinase. It is also expressed on the vast majority of non-Hodgkin's lymphoma (NHL) cells as well as some leukemias.

Because of their critical role in regulating the immune system, disregulation of B cells is associated with a variety of disorders. B-cell disorders, also referred to herein as B-cell related diseases, are divided into excessive or uncontrolled proliferation (lymphomas, leukemias), and defects of B-cell development/immunoglobulin production (immunodeficiencies).

The amino acid sequence of CD19 is as follows:

```
MPPPRLLFFLLFLTPMEVRPEEPLVVKVEEGDNAVLQCLKGTSDGP

TQQLTWSRESPLKPFLKLSLGLPGLGIHMRPLAIWLFIFNVSQQMG

GFYLCQPGPPSEKAWQPGWTVNVEGSGELFRWNVSDLGGLGCGLKN

RSSEGPSSPSGKLMSPKLYVWAKDRPEIWEGEPPCLPPRDSLNQSL

SQDLTMAPGSTLWLSCGVPPDSVSRGPLSWTHVHPKGPKSLLSLEL

KDDRPARDMWVMETGLLLPRATAQDAGKYYCHRGNLTMSFHLEITA

RPVLWHWLLRTGGWKVSAVTLAYLIFCLCSLVGILHLQRALVLRRK

RKRMTDPTRRFFKVTPPPGSGPQNQYGNVLSLPTPTSGLGRAQRWA

AGLGGTAPSYGNPSSDVQADGALGSRSPPGVGPEEEEGEGYEEPDS

EEDSEFYENDSNLGQDQLSQDGSGYENPEDEPLGPEDEDSFSNAES

YENEDEELTQPVARTMDFLSPHGSAWDPSREATSLGSQSYEDMRGI

LYAAPQLRSIRGQPGPNHEEDADSYENMDNPDGPDPAWGGGGRMGT

WSTR (SEQ ID NO: 1095).
```

In some embodiments, the antigen-binding constructs described herein include an antigen-binding polypeptide construct that binds to a CD19 antigen (anti-CD19 scFv or Fab).

In some embodiments, the anti-CD19 scFv or Fab is an scFv or Fab of a known anti-CD19 antibody, or is derived from, e.g., is a modified version of the scFv or Fab of a known anti-CD19 antibody. Antibodies directed against CD19 which provide for variable regions (VH and VL) to be employed in the bi-specific antigen-binding construct described herein are known in the art and include HD37, provided by the HD37 hybridoma (Pezzutto (1997), J. Immunol. 138, 2793-9). Additional anti-CD19 antibodies include "HD37 blocking antibodies" that block by 50% or greater the binding of HD37 to the CD19 antigen. Examples include but are not limited to HD237 (IgG2b) (Fourth International Workshop on Human Leukocyte Differentiation Antigens, Vienna, Austria, 1989; and Pezzutto et al., J. Immunol., 138(9):2793-2799 (1987)); 4G7 (Meecker (1984) Hybridoma 3, 305-20); B4 (Freedman (1987) Blood 70, 418-27); B43 (Bejcek (1995) Cancer Res. 55, 2346-51) and Mor-208 (Hammer (2012) Mabs4:5, 571-577).

In one embodiment said VH(CD19) and VL(CD19) regions (or parts, like CDRs, thereof) are derived from the anti-CD19 antibody HD37, provided by the HD37 hybridoma (Pezzutto (1997), J. Immunol. 138, 2793-9).

In some embodiments, the binding affinity of the second antigen-binding polypeptide construct for the target antigen is between about 0.1 nM to about 10 nM or less than 5.0, 4.0, 3.0, 2.0, 1.0, 0.9, 0.09, 0.9, 0.7, 0.6, 0.5, 0.4, 0.3, or less than 0.2 nM. In some embodiments, the binding affinity of the second antigen-binding polypeptide construct to CD19 on the surface of CD19+ target cells is in the range of 0.1 to 0.5, 0.5-1, 1-3, 3-5, 5-7, 7-9, 9-11, 11-13, 13-15, 15-17, 17-19 or 19-21 nM as measured by FACS analysis.

In certain embodiments, the antigen-binding polypeptide construct is an scFv or Fab construct that binds CD19 on a B cell. In some embodiments the scFv or Fab construct is mammalian. In one embodiment said scFv or Fab construct is human. In another embodiment said scFv or Fab construct is humanized. In yet another embodiment said scFv or Fab construct comprises at least one of human heavy and light chain variable regions.

In certain embodiments, the antigen-binding polypeptide construct exhibits cross-species binding to a least one antigen expressed on the surface of a B cell. In some embodiments, the antigen-binding polypeptide construct of an antigen-binding construct described herein bind to at least one of mammalian CD19. In certain embodiments, the CD19 antigen-binding polypeptide construct binds a human CD19.

CDH3

In some embodiments, a drug-conjugated antigen-binding construct may have an antigen-binding polypeptide construct directed against CDH3. CDH3, also known as CADH3; cadherin 3, type 1 or P-cadherin (Uniprot ID #P22223) is a member of the cadherin family of cell adhesion proteins that preferentially interact with themselves in a homophilic manner in cell-cell adhesion. CDH3 overexpression is associated with several types of cancer. In some embodiments, anti-CDH3 antibodies in Table KK are used to derive antigen-binding polypeptide constructs specific for CDH3.

TABLE KK

| Antibody | Patent/paper reference: |
| --- | --- |
| anti-HER2 | |
| trastuzumab | PCT/US1998/026266; Baselga J., et al, 1998, Cancer Res., 58: 2825-31 |
| pertuzumab | PCT/US2005/025084; DeGrendele H., 2003, Clin Prostate Cancer, 2: 143-5 |
| ertumaxomab | PCT/EP2008/001551; Kiewe P, et al, 2006, Clin. Cancer Res., 12: 3085-91 |
| margetuximab | PCT/US2009/038201 |
| XMT-1522 | PCT/US2015/036431 |
| MIL5_scFv | Qiao C, et al., 2013, J. Biomol. Struct. Dyn., 31: 511-21 |
| 7C2, 7F3 | U.S. Pat. No. 14,511,604 |
| anti-HER3 | |
| seribantumab | PCT/US2008/002119; Schoeberl B., et al., 2009, Sci Signal, 2: ra31 |
| patritumab | PCT/EP2006/012632; LoRusso P., et al, 2013, Clin Cancer Res., 19: 3078-87 |
| elgemtumab | PCT/EP2011/064407; Garrett J T., et al., 2013, Cancer Res., 73: 6013-23 |
| lumretuzumab | PCT/EP2010/070062; Mirschberger C., et al., 2013, Cancer Res., 73: 5183-94 |
| KTN3379 | PCT/US2012/066038; Lee S., et al., 2015, Proc Natl Acad Sci USA., 112: 13225-30 |
| 15D5 and 1D9 | PCT/US2011/050322 |
| REGN1400 | PCT/US2012/056446 |
| anti-EGFR | |
| cetuximab | PCT/US1996/009847; Prewett M., et al., 1996, J Immunother Emphasis Tumor Immunol, 19: 419-27 |
| panitumumab | PCT/US2003/015734; Yang X D, et al., 2001, Crit Rev Oncol Hematol., 38: 17-23 |
| nimotuzumab | PCT/CA2012/050034; Spicer J., 2005, Curr. Opin. Mol. Ther., 7: 182-91 |
| necitumumab | PCT/US2005/009583; Lu D., et al., 2005, J. Biol. Chem., 280: 19665-7 |
| zalutumumab | PCT/US2002/018748; Lammerts van Bueren J J., et al., 2008, Proc. Natl. Acad. Sci. U.S.A., 105: 6109-14 |

TABLE KK-continued

| Antibody | Patent/paper reference: |
|---|---|
| matuzumab | PCT/EP2002/001687; Vanhoefer U., et al., 2004, J. Clin. Oncol., 22: 175-84 |
| imgatuzumab | PCT/IB2006/000238; Gerdes C A., et al., 2013, Clin Cancer Res., 19: 1126-38 |
| depatuxizumab | PCT/US2007/019988; Gan H K., et al., 2007, J. Biol. Chem., 282: 2840-50 |
| anti-CDH3 | |
| FF-21101 | PCT/JP2010/057694 |
| Oncotherapy Clone #6 | PCT/JP2007/054374 |
| PF-03732010 | PCT/IB2006/001053; 2010, Zhang C C., et al., Clin. Cancer Res., 16: 5177-88 |
| PCA062 | PCT/IB2015/058801 |
| PF-06671008 | PCT/IB2015/054829 |

HER2, HER3 and EGFR

HER2, HER3 and EGFR are a HER receptors. A "HER receptor" is a receptor protein tyrosine kinase which belongs to the human epidermal growth factor receptor (HER) family and includes EGFR, HER2, HER3 and HER4 receptors. A HER receptor will generally comprise an extracellular domain, which may bind an HER ligand; a lipophilic transmembrane domain; a conserved intracellular tyrosine kinase domain; and a carboxyl-terminal signaling domain harboring several tyrosine residues which can be phosphorylated. HER2, HER3 and EGFR are overexpressed in numerous types of cancer. In some embodiments, the anti-HER2, anti-HER3 and anti-EGFR antibodies in Table KK are used to derive antigen-binding polypeptide constructs.

Other Target Antigens

In some embodiments, the drug-conjugated antigen-binding construct comprises a second antigen-binding polypeptide construct that is specific for one of the target antigens provided in Table LL. In some embodiments, the target antigen is a pathogen-derived antigen. In an embodiment, the target antigen is a viral antigen. In some embodiments, the target antigen is a fungal antigen. In some embodiments, the target antigen is bacterial. In some embodiments, the target antigen is a parasite antigen. In some embodiments the target antigen is associated with a hematological cancer. In some embodiments, the target antigen is expressed on a solid tumor. In some embodiments, the target antigen is associated with an autoimmune disease.

TABLE LL

Target Antigens
Viral targets

| Family | Genus | Virus |
|---|---|---|
| Retroviridae | *Lentivirus* | human immunodeficiency virus |
| Papillomaviridae | Many | Human papilloma virus |
| Paramyxoviridae | Pneumovirus | Human respiratory syncytial virus |
| Filoviridae | *Ebolavirus* | Ebola virus |
| Coronaviridae | *Betacoronavirus* | *SARS coronavirus* |
| Orthomyxoviridae | Influenza A, B, C | Influenza |
| Hepadnaviridae | *Orthohepadnavirus* | Hepatitis B virus |
| Flaviviridae | *Hepacivirus* | Hepatitis C virus |
| Flaviviridae | *Flavivirus* | Zika virus |
| Flaviviridae | *Flavivirus* | Dengue virus |
| Flaviviridae | *Flavivirus* | West Nile Virus |
| Herpesviridae | *Simplexvirus* | Herpes simplex virus |
| Herpesviridae | *Lymphocryptovirus* | Epstein-Barr Virus |
| Herpesviridae | *Varicellovirus* | Varicella-Zoster virus |
| Herpesviridae | *Cytomegalovirus* | *Cytomegalovirus* |

Bacterial/fungal Targets

| Family | Genus | Species |
|---|---|---|
| Brucellaceae | *Brucella* | *B. melitensis* |
| Chlamydiaceae | *Chlamydia* | *C. trachomatis* |
| Chlamydiaceae | *Chlamydophila* | *C. pneumoniae* |
| Clostridiaceae | *Clostridium* | *C. difficile* |
| Coxiellaceae | *Coxiella* | *C. burnetii* |
| Legionellaceae | *Legionella* | *L. pneumophila* (many more) |
| Listeriaceae | *Listeria* | *L. monocytogenes* |
| Mycobacteriaceae | *Mycobacterium* | *M. tuberculosis, M. leprae* |
| Neisseriaceae | *Neisseria* | *N. gonorrhoeae, N. meningitidis* |
| Rickettsiaceae | *Rickettsia* | Numerous species in three groups: Spotted fever (*R. rickettsii*) Typhus (*R. prowazekii*) and Scrub-typhus (*Orientia tsutsugamushi*) |
| Enterobacteriaceae | *Salmonella* | *S. bongori, S. enterica* |
| Enterobacteriaceae | *Shigella* | *S. boydii, S. dysenteriae, S. flexneri, S. sonnei* |

TABLE LL-continued

| | Target Antigens | |
|---|---|---|
| | Viral targets | |
| Enterobacteriaceae | *Yersinia* | *Y. pestis, Y. pseudotuberculosis* |
| Tremellaceae | *Cryptococcus* | *C. neoformans* |
| Trichocomaceae | *Aspergillus* | *Aspergillus* spp |
| | Parasitic Targets | |
| Family | Genus | Species |
| Cryptosporidiidae | *Cryptosporidium* | *C. parvum* |
| Plasmodium | *Plasmodium* | *P. falciparum, P. vivax, P. ovale,* and *P. malariae* |
| Trypanosomatidae | *Leishmania* | *L. donovani* (~20 species infect humans) |
| Sarcocystidae | *Toxoplasma* | *T. gondii* |
| Trypanosomatidae | *Trypanosoma* | *T. cruzi, T. brucei* |
| | Human targets | |
| Gene ID | Uniprot ID | Disease Association |
| | Cancer | |
| | Hemooncology | |
| CD8 | P10966 | T cell activation? |
| CD19 | P15391 | B-cell malignancies, autoimmune disease |
| CD20 | P11836 | Chronic Lymphocytic Leukemia, Non-Hodgkin's Lymphoma, Rheumatoid Arthritis |
| CD22 | P20273 | Non-Hodgkin's Lymphoma, B-cell malignancies |
| CD30 | P28908 | Anaplastic Large Cell Lymphoma Hematologic malignancies Hodgkin Lymphoma |
| CD33 | P20138 | Acute myeloid leukemia |
| CD37 | P11049 | Acute myeloid leukemia Chronic Lymphocytic Leukemia Non-Hodgkin's Lymphoma |
| CD38 | P28907 | Hematologic malignancies, Multiple Myeloma |
| CD44v6 | P16070 | Squamous cell carcinoma, Hematologic malignancies |
| CD74 | P04233 | Chronic Lymphocytic Leukemia Multiple Myeloma |
| CD79b | P40259 | Non-Hodgkin's Lymphoma, Systemic lupus erythematosus |
| CD133 | O43490 | Acute lymphoblastic leukemia Acute myeloid leukemia |
| CD138 | P18827 | Multiple Myeloma |
| IL-3Rα | P26951 | Acute myeloid leukemia, Hodgkin Lymphoma |
| BCMA | Q02223 | B-cell malignancies, Multiple Myeloma |
| CLEC12A | Q5QGZ9 | Acute myeloid leukemia |
| FLT3 | P36888 | Acute myeloid leukemia |
| ROR 1 | Q01973 | Chronic Lymphocytic Leukemia, B-cell malignancies |
| | Solid tumor | |
| CD70 (CD27L) | P32970 | Renal Cell Carcinoma, Autoimmune Diseases, Cancer, Inflammatory Diseases |
| CD117 | P10721 | Inflammatory Diseases, Cancer, Acute myeloid leukemia |
| CD56 | P13591 | Multiple Myeloma, Solid Tumors |
| CD98 | P08195 | head and neck squamous cell carcinoma cells with stem cell properties |
| Notch 1 | P46531 | solid tumors- broad indications |
| Notch 2 | Q04721 | solid tumors- broad indications |
| Notch 3 | Q9UM47 | solid tumors- broad indications |
| Notch 4 | Q99466 | solid tumors- broad indications |
| DL44 | Q9NR61 | solid tumors- broad indications |
| PSMA | Q04609 | Prostate Cancer |
| PSA | P07288 | Prostate Cancer |
| PSCA | O43653 | Prostate Cancer |
| STEAP1 | Q9UHE8 | Prostate Cancer, Multiple Others |
| CEACAM4 | O75871 | Colorectal Cancer |

TABLE LL-continued

Target Antigens
Viral targets

| | | |
|---|---|---|
| CEACAM5 | P06731 | Colorectal Cancer, Pancreatic Cancer, Gastric Cancer |
| alpha-V integrin | P06756 | melanoma, glioma, ovarian, and breast cancer |
| EphA2 | P29317 | solid tumors |
| Epha10 | Q5JZY3 | Breast Cancer |
| EpCAM | P16422 | solid tumors |
| Cadherin-19 | J3KTP3 | Melanoma |
| P-cadherin | P22223 | solid tumors |
| Nectin-4 | Q96NY8 | Metastatic Urothelial Cancer |
| Glypican 3 | P51654 | Liver Cancer |
| EGFR/EGFRvIII | P00533 | solid tumors- broad indications |
| VEGFR | P17948 | endothelial cell - solid tumor |
| HER2/neu | P04626 | Breast Cancer, Head and Neck Cancer, ovarian, prostate |
| Her3 | P21860 | Solid tumors- |
| IGF1R | P08069 | solid tumors and hematological malignancies |
| c-MET | P08581 | Solid tumors |
| folate receptor alpha | P15328 | Ovarian Cancer |
| folate receptor beta | P14207 | Acute myeloid leukemia, Ovarian Cancer |
| Endothelin B receptor | P24530 | Melanoma |
| TF (Tissue Factor) | P13726 | Pancreatic Cancer, Acute Lung Injury, Inflammatory Diseases |
| MSLN | Q13421 | Mesothelioma, Breast Cancer, Ovarian cancer |
| ENPP3 | O14638 | Liver Cancer, Renal Cell Carcinoma |
| TPBG | Q13641 | Non-Small Cell Lung cancer, Renal Cell Carcinoma |
| FAP | Q12884 | Stromal Targeting, Colorectal Cancer |
| HMW-MAA | Q6UVK1 | Melanoma, Breast Cancer |
| A33 | Q99795 | Colorectal Cancer |
| B7-H3 | Q5ZPR3 | Solid tumors |
| B7-H4 | Q7Z7D3 | Solid tumors |
| GPNMB | Q14956 | Breast Cancer, Melanoma, |
| CFC1B | P0CG36 | Solid tumors |
| TACSTD (Trop2) | P09758 | Breast Cancer, Gastric Cancer, Pancreatic Cancer |
| TAG-72 | Q9XVS1 | Prostate, Breast, Colon, Lung, and Pancreatic cancers |
| TIM-3 | Q8TDQ0 | Immune Checkpoint, Cancer, Autoimmunity, Inflammation |
| Guanylyl cyclase C (GCC)/GUCY2C | P25092 | Pancreatic Cancer |
| SLC44A4 | Q53GD3 | Pancreatic Cancer, Prostate Cancer |
| SLC34A2 | O95436 | Non-Small Cell Lung cancer, Ovarian Cancer |
| SLC39A6 | Q13433 | Breast Cancer |
| CanAg (a glycoform of MUC1) | P15941 | Breast Cancer |
| Mucin 16 (CA125) | Q8WXI7 | Epithelial Ovarian Cancer, Breast Cancer |
| CAIX | Q16790 | Renal Cell Carcinoma |
| RAAG12 | N-linked carbohydrate epitope | Adenocarcinoma |
| Sialyl LewisA | carbohydrate epitope | Gastrointestinal cancers |
| Lewis Y (Le(y)) antigen | carbohydrate epitope | Gastrointestinal cancers |
| Autoimmune disease/Inflammation | | |
| CD19 | see above | autoimmune disease |
| CD20 | see above | Rheumatoid Arthritis |
| CD70 (CD27L) | see above | Autoimmune Diseases, Cancer, Inflammatory Diseases |
| CD79b | see above | Systemic lupus erythematosus |
| IL-5Rα | Q01344 | Asthma, Chronic obstructive pulmonary disease |
| IL-23R | Q9NPF7 | Inflammatory Diseases, Autoimmune Diseases, Cancer |
| TF (Tissue Factor) | see above | Acute Lung Injury, Inflammatory Diseases |
| TIM-3 | see above | Autoimmunity, Inflammation |
| Viral infections- human targets | | |
| TSG101 | Q99816 | HIV, Herpes, Influenza, Ebola |
| WNV E | Q91KZ4 | West Nile Virus |

TABLE LL-continued

Target Antigens
Viral targets

| | | |
|---|---|---|
| CD81 | P60033 | HCV (entry) |
| CD4 | P01730 | HIV |
| CXCR4 | P61073 | HIV |
| CCR5 | P51681 | HIV |
| Integrin αL | P20701 | HIV |

Scaffolds

In some embodiments, the antigen-binding constructs described herein comprise a scaffold. A scaffold may be a peptide, polypeptide, polymer, nanoparticle or other chemical entity. In embodiments where the scaffold is an Fc or dimeric Fc, the antigen-binding polypeptide construct(s) of the antigen-binding construct may be linked to either the N- or C-terminus of the scaffold. A dimeric Fc can be homodimeric or heterodimeric.

In embodiments where the scaffold is a peptide or polypeptide, the antigen-binding construct or antigen-binding polypeptide construct may be linked to the scaffold by genetic fusion with or without polypeptide linkers. In other embodiments, where the scaffold is a polymer or nanoparticle, the antigen-binding construct may be linked to the scaffold by chemical conjugation. In some embodiments, the scaffold is an albumin polypeptide or split albumin polypeptide. The use of split albumin polypeptides as scaffolds for antigen-binding polypeptide constructs is fully described in PCT/CA2012/050131, PCT/US2013/050408 and PCT/US2013/050411 all of which are hereby incorporated by reference in their entirety.

Fc of Antigen-Binding Constructs.

Fc polypeptides make excellent scaffolds for antigen-binding polypeptide constructs. Certain antigen-binding constructs described herein comprise an Fc, e.g., a dimeric Fc. In some embodiments, the Fc is a heterodimeric Fc comprising first and second Fc polypeptides each comprising a modified CH3 sequence, wherein each modified CH3 sequence comprises asymmetric amino acid modifications that promote the formation of a heterodimeric Fc and the dimerized CH3 domains have a melting temperature (Tm) of about 68° C. or higher, and wherein the first Fc polypeptide is linked to the first antigen-binding polypeptide construct, with a first hinge linker, and the second Fc polypeptide is linked to the second antigen-binding polypeptide construct with a second hinge linker.

The term "Fc domain" or "Fc region" herein is used to define a C-terminal region of an immunoglobulin heavy chain that contains at least a portion of the constant region. The term includes native sequence Fc regions and variant Fc regions. Unless otherwise specified herein, numbering of amino acid residues in the Fc region or constant region is according to the EU numbering system, also called the EU index, as described in Kabat et al, Sequences of Proteins of Immunological Interest, 5th Ed. Public Health Service, National Institutes of Health, Bethesda, Md., 1991. An "Fc polypeptide" of a dimeric Fc as used herein refers to one of the two polypeptides forming the dimeric Fc domain, i.e. a polypeptide comprising C-terminal constant regions of an immunoglobulin heavy chain, capable of stable self-association. For example, an Fc polypeptide of a dimeric IgG Fc comprises an IgG CH2 and an IgG CH3 constant domain sequence.

An Fc domain comprises either a CH3 domain or a CH3 and a CH2 domain. The CH3 domain comprises two CH3 sequences, one from each of the two Fc polypeptides of the dimeric Fc. The CH2 domain comprises two CH2 sequences, one from each of the two Fc polypeptides of the dimeric Fc.

In some aspects, the Fc comprises at least one or two CH3 sequences. In some aspects, the Fc is coupled, with or without one or more linkers, to a first antigen-binding construct and/or a second antigen-binding construct. In some aspects, the Fc is a human Fc. In some aspects, the Fc is a human IgG or IgG1 Fc. In some aspects, the Fc is a heterodimeric Fc. In some aspects, the Fc comprises at least one or two CH2 sequences.

In some aspects, the Fc comprises one or more modifications in at least one of the CH3 sequences. In some aspects, the Fc comprises one or more modifications in at least one of the CH2 sequences. In some aspects, an Fc is a single polypeptide. In some aspects, an Fc is multiple peptides, e.g., two polypeptides.

In some aspects, the Fc is an Fc described in patent applications PCT/CA2011/001238, filed Nov. 4, 2011 or PCT/CA2012/050780, filed Nov. 2, 2012, the entire disclosure of each of which is hereby incorporated by reference in its entirety for all purposes.

Modified CH3 Domains

In some aspects, the antigen-binding construct described herein comprises a heterodimeric Fc comprising a modified CH3 domain that has been asymmetrically modified. The heterodimeric Fc can comprise two heavy chain constant domain polypeptides: a first Fc polypeptide and a second Fc polypeptide, which can be used interchangeably provided that Fc comprises one first Fc polypeptide and one second Fc polypeptide. Generally, the first Fc polypeptide comprises a first CH3 sequence and the second Fc polypeptide comprises a second CH3 sequence.

Two CH3 sequences that comprise one or more amino acid modifications introduced in an asymmetric fashion generally results in a heterodimeric Fc, rather than a homodimer, when the two CH3 sequences dimerize. As used herein, "asymmetric amino acid modifications" refers to any modification where an amino acid at a specific position on a first CH3 sequence is different from the amino acid on a second CH3 sequence at the same position, and the first and second CH3 sequence preferentially pair to form a heterodimer, rather than a homodimer. This heterodimerization can be a result of modification of only one of the two amino acids at the same respective amino acid position on each sequence; or modification of both amino acids on each sequence at the same respective position on each of the first and second CH3 sequences. The first and second CH3 sequence of a heterodimeric Fc can comprise one or more than one asymmetric amino acid modification.

Table C provides the amino acid sequence of the human IgG1 Fc sequence, corresponding to amino acids 231 to 447 of the full-length human IgG1 heavy chain. Amino acids 231-238 are also referred to as the lower hinge. The CH3 sequence comprises amino acid 341-447 of the full-length human IgG1 heavy chain.

Typically an Fc can include two contiguous heavy chain sequences (A and B) that are capable of dimerizing. With respect to the antigen binding constructs described herein, in some embodiments the first scFv is linked to chain A of the heterodimeric Fc and the second scFv is linked to chain B of the heterodimeric Fc. In some embodiments, the second scFv is linked to chain A of the heterodimeric Fc and the first scFv is linked to chain B of the heterodimeric Fc.

In some aspects, one or both sequences of an Fc include one or more mutations or modifications at the following locations: L351, F405, Y407, T366, K392, T394, T350, S400, and/or N390, using EU numbering. In some aspects, an Fc includes a mutant sequence shown in Table X. In some aspects, an Fc includes the mutations of Variant 1 A-B. In some aspects, an Fc includes the mutations of Variant 2 A-B. In some aspects, an Fc includes the mutations of Variant 3 A-B. In some aspects, an Fc includes the mutations of Variant 4 A-B. In some aspects, an Fc includes the mutations of Variant 5 A-B.

TABLE C

IgG1 Fc sequence and variants

| Human IgG1 Fc sequence 231-447 (EU-numbering) | APELLGGPSVFLFPPKPKDTLMIS RTPEVTCVVVDVSHEDPEVKFNWY VDGVEVHNAKTKPREEQYNSTYRV VSVLTVLHQDWLNGKEYKCKVSNK ALPAPIEKTISKAKGQPREPQVYT LPPSRDELTKNQVSLTCLVKGFYP SDIAVEWESNGQPENNYKTTPPVL DSDGSFFLYSKLTVDKSRWQQGNV FSCSVMHEALHNHYTQKSLSLSPG K (SEQ ID NO: 1096) | |
|---|---|---|

| Variant IgG1 Fc sequence (231-447) | Chain | Mutations |
|---|---|---|
| 1 | A | L351Y_F405A_Y407V |
| 1 | B | T366L_K392M_T394W |
| 2 | A | L351Y_F405A_Y407V |
| 2 | B | T366L_K392L_T394W |
| 3 | A | T350V_L351Y_F405A_Y407V |
| 3 | B | T350V_T366L_K392L_T394W |
| 4 | A | T350V_L351Y_F405A_Y407V |
| 4 | B | T350V_T366L_K392M_T394W |
| 5 | A | T350V_L351Y_S400E_F405A_Y407V |
| 5 | B | T350V_T366L_N390R_K392M_T394W |

The first and second CH3 sequences can comprise amino acid mutations as described herein, with reference to amino acids 231 to 447 of the full-length human IgG1 heavy chain. In one embodiment, the heterodimeric Fc comprises a modified CH3 domain with a first CH3 sequence having amino acid modifications at positions F405 and Y407, and a second CH3 sequence having amino acid modifications at position T394. In one embodiment, the heterodimeric Fc comprises a modified CH3 domain with a first CH3 sequence having one or more amino acid modifications selected from L351Y, F405A, and Y407V, and the second CH3 sequence having one or more amino acid modifications selected from T366L, T366I, K392L, K392M, and T394W.

In one embodiment, a heterodimeric Fc comprises a modified CH3 domain with a first CH3 sequence having amino acid modifications at positions L351, F405 and Y407, and a second CH3 sequence having amino acid modifications at positions T366, K392, and T394, and one of the first or second CH3 sequences further comprising amino acid modifications at position Q347, and the other CH3 sequence further comprising amino acid modification at position K360. In another embodiment, a heterodimeric Fc comprises a modified CH3 domain with a first CH3 sequence having amino acid modifications at positions L351, F405 and Y407, and a second CH3 sequence having amino acid modifications at position T366, K392, and T394, one of the first or second CH3 sequences further comprising amino acid modifications at position Q347, and the other CH3 sequence further comprising amino acid modification at position K360, and one or both of said CH3 sequences further comprise the amino acid modification T350V.

In one embodiment, a heterodimeric Fc comprises a modified CH3 domain with a first CH3 sequence having amino acid modifications at positions L351, F405 and Y407, and a second CH3 sequence having amino acid modifications at positions T366, K392, and T394 and one of said first and second CH3 sequences further comprising amino acid modification of D399R or D399K and the other CH3 sequence comprising one or more of T411E, T411D, K409E, K409D, K392E and K392D. In another embodiment, a heterodimeric Fc comprises a modified CH3 domain with a first CH3 sequence having amino acid modifications at positions L351, F405 and Y407, and a second CH3 sequence having amino acid modifications at positions T366, K392, and T394, one of said first and second CH3 sequences further comprises amino acid modification of D399R or D399K and the other CH3 sequence comprising one or more of T411E, T411D, K409E, K409D, K392E and K392D, and one or both of said CH3 sequences further comprise the amino acid modification T350V.

In one embodiment, a heterodimeric Fc comprises a modified CH3 domain with a first CH3 sequence having amino acid modifications at positions L351, F405 and Y407, and a second CH3 sequence having amino acid modifications at positions T366, K392, and T394, wherein one or both of said CH3 sequences further comprise the amino acid modification of T350V.

In one embodiment, a heterodimeric Fc comprises a modified CH3 domain comprising the following amino acid modifications, where "A" represents the amino acid modifications to the first CH3 sequence, and "B" represents the amino acid modifications to the second CH3 sequence: A:L351Y_F405A_Y407V, B:T366L_K392M_T394W, A:L351Y_F405A_Y407V, B:T366L_K392L_T394W, A:T350V_L351Y_F405A_Y407V, B:T350V_T366L_K392L_T394W, A:T350V_L351Y_F405A_Y407V, B:T350V_T366L_K392M_T394W, A:T350V_L351Y_S400E_F405A_Y407V, and/or B:T350V_T366L_N390R_K392M_T394W.

The one or more asymmetric amino acid modifications can promote the formation of a heterodimeric Fc in which the heterodimeric CH3 domain has a stability that is comparable to a wild-type homodimeric CH3 domain. In an embodiment, the one or more asymmetric amino acid modifications promote the formation of a heterodimeric Fc domain in which the heterodimeric Fc domain has a stability that is comparable to a wild-type homodimeric Fc domain.

In an embodiment, the one or more asymmetric amino acid modifications promote the formation of a heterodimeric Fc domain in which the heterodimeric Fc domain has a stability observed via the melting temperature (Tm) in a differential scanning calorimetry study, and where the melting temperature is within 4° C. of that observed for the corresponding symmetric wild-type homodimeric Fc domain. In some aspects, the Fc comprises one or more modifications in at least one of the CH3 sequences that promote the formation of a heterodimeric Fc with stability comparable to a wild-type homodimeric Fc.

In one embodiment, the stability of the CH3 domain can be assessed by measuring the melting temperature of the CH3 domain, for example by differential scanning calorimetry (DSC). Thus, in a further embodiment, the CH3 domain has a melting temperature of about 68° C. or higher. In another embodiment, the CH3 domain has a melting temperature of about 70° C. or higher. In another embodiment, the CH3 domain has a melting temperature of about 72° C. or higher. In another embodiment, the CH3 domain has a melting temperature of about 73° C. or higher. In another embodiment, the CH3 domain has a melting temperature of about 75° C. or higher. In another embodiment, the CH3 domain has a melting temperature of about 78° C. or higher. In some aspects, the dimerized CH3 sequences have a melting temperature (Tm) of about 68, 69, 70, 71, 72, 73, 74, 75, 76, 77, 77.5, 78, 79, 80, 81, 82, 83, 84, or 85° C. or higher.

In some embodiments, a heterodimeric Fc comprising modified CH3 sequences can be formed with a purity of at least about 75% as compared to homodimeric Fc in the expressed product. In another embodiment, the heterodimeric Fc is formed with a purity greater than about 80%. In another embodiment, the heterodimeric Fc is formed with a purity greater than about 85%. In another embodiment, the heterodimeric Fc is formed with a purity greater than about 90%. In another embodiment, the heterodimeric Fc is formed with a purity greater than about 95%. In another embodiment, the heterodimeric Fc is formed with a purity greater than about 97%. In some aspects, the Fc is a heterodimer formed with a purity greater than about 75, 76, 77, 78, 79, 80, 81, 82, 83, 84, 85, 86, 87, 88, 89, 90, 91, 92, 93, 94, 95, 96, 97, 98, or 99% when expressed. In some aspects, the Fc is a heterodimer formed with a purity greater than about 75, 76, 77, 78, 79, 80, 81, 82, 83, 84, 85, 86, 87, 88, 89, 90, 91, 92, 93, 94, 95, 96, 97, 98, or 99% when expressed via a single cell.

Additional methods for modifying monomeric Fc polypeptides to promote heterodimeric Fc formation are known in the art. For example, see International Patent Publication No. WO 96/027011 (knobs into holes), in Gunasekaran et al. (Gunasekaran K. et al. (2010) J Biol Chem. 285, 19637-46, electrostatic design to achieve selective heterodimerization), in Davis et al. (Davis, M. et al. (2010) Prot Eng Des Sel; 23(4): 195-202, strand exchange engineered domain (SEED) technology), and in Labrijn et al [Efficient generation of stable bi-specific IgG1 by controlled Fab-arm exchange. Labrijn A F, Meesters J I, de Goeij B E, van den Bremer E T, Neijssen J, van Kampen M D, Strumane K, Verploegen S, Kundu A, Gramer M J, van Berkel P H, van de Winkel J G, Schuurman J, Parrett P W. Proc Natl Acad Sci USA. 2013 Mar. 26; 110(13):5145-50.

CH2 Domains

As indicated above, in some embodiments, the Fc of the antigen-binding construct comprises a CH2 domain in addition to a CH3 domain. As an example, the amino acid sequence of the CH2 domain of an IgG1 Fc is identified as amino acids 239-340 of the sequence shown in Table A. The CH2 domain of the Fc binds to Fc receptors and complement and is thus involved in mediating effector cell functions.

The terms "Fc receptor" and "FcR" are used to describe a receptor that binds to the Fc region of an antibody, and includes Fc gamma receptors (FcγRs) and the neonatal receptor FcRn.

Generally, an FcγR is one which binds an IgG antibody (a gamma receptor) and includes receptors of the FcγRI, FcγRII, and FcγRIII subclasses in humans, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. Immunoglobulins of other isotypes can also be bound by certain FcRs (see, e.g., Janeway et al., Immuno Biology: the immune system in health and disease, (Elsevier Science Ltd., NY) (4th ed., 1999)). Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain (reviewed in Daëron, Annu. Rev. Immunol. 15:203-234 (1997)). FcRs are reviewed in Ravetch and Kinet, Annu. Rev. Immunol 9:457-92 (1991); Capel et al., Immunomethods 4:25-34 (1994); and de Haas et al., J. Lab. Clin. Med. 126:330-41 (1995). Other FcγRs, including those to be identified in the future, are encompassed by the term "FcR" herein. An FcγR are also found in other organisms, including but not limited to mice, rats, rabbits, and monkeys. Mouse FcγRs include but are not limited to FcγRI (CD64), FcγRII (CD32), FcγRIII (CD 16), and FcγRIII-2 (CD 16-2). FcγRs are expressed by effector cells such as NK cells or B cells.

Complement activation requires binding of the complement protein C1q to antigen-antibody complexes. Residues in the CH2 domain of the Fc are involved in the interaction between C1q and the Fc.

Some of the antigen-binding constructs described herein are able to bind FcRn. As is known in the art, binding to FcRn recycles endocytosed antibody from the endosome back to the bloodstream (Raghavan et al., 1996, Annu Rev Cell Dev Biol 12:181-220; Ghetie et al., 2000, Annu Rev Immunol 18:739-766). This process, coupled with preclusion of kidney filtration due to the large size of the full-length molecule, results in favorable antibody serum half-lives ranging from one to three weeks. Binding of Fc to FcRn also plays a key role in antibody transport. FcRn is responsible for the transfer of maternal IgGs to the fetus (Guyer et al., J. Immunol. 117:587 (1976); and Kim et al., J. Immunol. 24:249 (1994)). Binding of the FcRn to IgG involves residues in the CH2 and CH3 domains of the Fc.

Modifications in the CH2 domain can affect the binding of FcRs to the Fc. As indicated above, the CH2 domain of the Fc comprises two CH2 sequences, one on each of the two Fc polypeptides of the dimeric Fc. Typically, the modifications to the CH2 domain are symmetric and are thus the same on both CH2 sequences of the Fc polypeptides. However, asymmetric mutations are also possible in the presence of mutations on the CH3 domain that enhance heterodimerization. In one embodiment, the CH2 domain comprises modifications to reduce FcγR or C1q binding and/or effector function.

Modifications to Reduce Effector Function:

Fc modifications reducing FcγR and/or complement binding and/or effector function are known in the art. Recent publications describe strategies that have been used to engineer antibodies with reduced or silenced effector activity (see Strohl, W R (2009), Curr Opin Biotech 20:685-691, and Strohl, W R and Strohl L M, "Antibody Fc engineering for optimal antibody performance" In Therapeutic Antibody Engineering, Cambridge: Woodhead Publishing (2012), pp 225-249). These strategies include reduction of effector function through modification of glycosylation, use of IgG2/IgG4 scaffolds, or the introduction of mutations in the hinge or CH2 regions of the Fc. For example, US Patent Publication No. 2011/0212087 (Strohl), International Patent Publication No. WO 2006/105338 (Xencor), US Patent Publication No. 2012/0225058 (Xencor), US Patent Publication No. 2012/0251531 (Genentech), and Strop et al ((2012) J. Mol. Biol. 420: 204-219) describe specific modifications to reduce FcγR or complement binding to the Fc.

Specific, non-limiting examples of known symmetric amino acid modifications to reduce FcγR or complement binding to the Fc include those identified in the following table:

TABLE D modifications to reduce FcγR or complement binding to the Fc

| Company | Mutations |
|---|---|
| GSK | N297A |
| Ortho Biotech | L234A/L235A |
| Protein Design labs | IGG2 V234A/G237A |
| Wellcome Labs | IGG4 L235A/G237A/E318A |
| GSK | IGG4 S228P/L236E |
| Alexion | IGG2/IgG4 combination |
| Merck | IGG2 H268Q/V309L/A330S/A331S |
| Bristol-Myers | C220S/C226S/C229S/P238S |
| Seattle Genetics | C226S/C229S/E3233P/L235V/L235A |
| Amgen | E. coli production, non glycosylated |
| Medimune | L234F/L235E/P331S |
| Trubion | Hinge mutant, possibly C226S/P230S |

In one embodiment, the Fc comprises at least one amino acid modification identified in the above table. In another embodiment the Fc comprises amino acid modification of at least one of L234, L235, or D265. In another embodiment, the Fc comprises amino acid modification at L234, L235 and D265. In another embodiment, the Fc comprises the amino acid modifications L234A, L235A and D265S.

In some embodiments the Fc comprises one or more asymmetric amino acid modifications in the lower hinge region of the Fc as described in International Patent Application No. PCT/CA2014/050507. Examples of such asymmetric amino acid modifications that reduce FcγR binding are shown in Table E:

TABLE E

Asymmetric mutations that reduce FcγR binding

| Chain A | Chain B |
|---|---|
| L234D/L235E | L234K/L235K |
| E233A/L234D/L235E | E233A/L234R/L235R |
| L234D/L235E | E233K/L234R/L235R |
| E233A/L234K/L235A | E233K/L234A/L235K |

Hinge Linkers

In the antigen-binding constructs described herein, the first Fc polypeptide is linked to the first antigen-binding polypeptide construct with a first hinge linker, and the second Fc polypeptide is linked to the second antigen-binding polypeptide construct with a second hinge linker. Examples of hinge linker sequences are well-known to one of skill in the art and can be used in the antigen-binding constructs described herein. Alternatively, modified versions of known hinge linkers can be used.

The hinge linker polypeptides are selected such that they maintain or optimize the functional activity of the antigen-binding construct. Suitable linker polypeptides include IgG hinge regions such as, for example those from $IgG_1$, $IgG_2$, or $IgG_4$, including the upper hinge sequences and core hinge sequences. The amino acid residues corresponding to the upper and core hinge sequences vary depending on the IgG type, as is known in the art and one of skill in the art would readily be able to identify such sequences for a given IgG type. Modified versions of these exemplary linkers can also be used. For example, modifications to improve the stability of the $IgG_4$ hinge are known in the art (see for example, Labrijn et al. (2009) Nature Biotechnology 27, 767-771). Examples of hinge linker sequences are found in the following Table. In some embodiments, the drug-conjugated antigen-binding constructs described herein have modifications to the hinge region to modify or optimize potency of the construct.

TABLE F

Hinge linker polypeptide sequences (SEQ ID NOS:)

| SEQ ID NO: | | |
|---|---|---|
| 1097 | IgG1 | EPKSCDKTHTCPPCP |
| 1098 | IgG1 | GAGCCCAAGAGCTGTGATAAGACCC ACACCTGCCCTCCCTGTCCA |
| 1099 | v1661 | AAEPKSSDKTHTCPPCP |
| 1100 | v1661 | GCAGCCGAACCCAAATCCTCTGATA AGACCCACACATGCCCTCCATGTCC A |
| 1101 | Hinge-1 | EPKSSDKTHTCPPCP |
| 1102 | Hinge-1 | GAGCCTAAAAGCTCCGACAAGACCC ACACATGCCCACCTTGTCCG |
| 1103 | Hinge-2 | DKTHTCPPCP |
| 1104 | Hinge-2 | GACAAGACCCACACATGCCCACCTT GTCCG |
| 1105 | Hinge-3 | GTCPPCP |
| 1106 | Hinge-3 | GGCACATGCCCTCCATGTCCA |

Dissociation Constant (KD) and Maximal Binding (Bmax)

In some embodiments, an antigen-binding construct is described by functional characteristics including but not limited to a dissociation constant and a maximal binding.

The term "dissociation constant ($K_D$)" as used herein, is intended to refer to the equilibrium dissociation constant of a particular ligand-protein interaction. As used herein, ligand-protein interactions refer to, but are not limited to protein-protein interactions or antibody-antigen interactions. The $K_D$ measures the propensity of two proteins (e.g. AB) to dissociate reversibly into smaller components (A+B), and is define as the ratio of the rate of dissociation, also called the "off-rate ($k_{off}$)", to the association rate, or "on-rate ($k_{on}$)". Thus, $K_D$ equals $k_{off}/k_{on}$ and is expressed as a molar concentration (M). It follows that the smaller the $K_D$, the stronger the affinity of binding. Therefore, a $K_D$ of 1 mM indicates weak binding affinity compared to a $K_D$ of 1 nM. $K_D$ values for antigen-binding constructs can be determined using methods well established in the art. One method for determining the $K_D$ of an antigen-binding construct is by using surface plasmon resonance (SPR), typically using a biosensor system such as a Biacore® system. Isothermal titration calorimetry (ITC) is another method that can be used to determine.

The term "Bmax", or maximal binding, refers to the maximum antigen-binding construct binding level on the cells at saturating concentrations of antigen-binding construct. This parameter can be reported in the arbitrary unit MFI for relative comparison, or converted into an absolute value corresponding to the number of antigen-binding constructs bound to the cell with the use of a standard curve.

The binding characteristics of an antigen-binding construct can be determined by various techniques. One of which is the measurement of binding to target cells expressing the antigen by flow cytometry (FACS, Fluorescence-activated cell sorting). Typically, in such an experiment, the target cells expressing the antigen of interest are incubated with antigen-binding constructs at different concentrations, washed, incubated with a secondary agent for detecting the antigen-binding construct, washed, and analyzed in the flow cytometer to measure the median fluorescent intensity (MFI) representing the strength of detection signal on the cells, which in turn is related to the number of antigen-binding constructs bound to the cells. The antigen-binding construct concentration vs. MFI data is then fitted into a saturation binding equation to yield two key binding parameters, Bmax and apparent $K_D$.

Apparent $K_D$, or apparent equilibrium dissociation constant, represents the antigen-binding construct concentration at which half maximal cell binding is observed. Evidently, the smaller the $K_D$ value, the smaller antigen-binding construct concentration is required to reach maximum cell binding and thus the higher is the affinity of the antigen-binding construct. The apparent $K_D$ is dependent on the conditions of the cell binding experiment, such as different receptor levels expressed on the cells and incubation conditions, and thus the apparent $K_D$ is generally different from the $K_D$ values determined from cell-free molecular experiments such as SPR and ITC. However, there is generally good agreement between the different methods.

In some embodiments of a drug-conjugated antigen-binding construct described herein, one antigen-binding polypeptide construct has a higher affinity for its cognate antigen than the other. In most embodiments of a drug-conjugated antigen-binding construct, the first antigen-binding polypeptide construct has a lower affinity for CD3 than the second antigen-binding polypeptide construct has for the target antigen. In some embodiments, the construct has at least 2, at least 5, at least 10, at least 20, at least 30, at least 40, at least 50, at least 60, at least 70, at least 80, at least 90 or at least 100-fold lower affinity for the CD3 antigen than for the target antigen, as measured by SPR; and/or has an an affinity of less than 10 nM for target cells bearing the target antigen and an affinity in the range of 10 nM-500 nM for T cells as measured by FACS.

In many embodiments, the affinity for CD3 will be lower than the affinity for the target antigen. In one embodiment of a CD3-CD19 drug-conjugated antigen-binding construct, the affinity for CD3 is lower than the affinity for CD19. In further embodiments, the affinity for CD3 is at least 2, 5, 10, 15 or 20-fold lower than the affinity for CD19. In one specific embodiment, the affinity of a CD3-CD19 drug-conjugated antigen-binding construct is 2 nM for CD19 and 30 nM for CD3. Affinities may be determined by SPR. In some embodiments the affinity of the second antigen-binding polypeptide construct for CD19 antigen expressed on a B cell is in the range of about 0.5-1, 1-3, 3-5, 5-7, 7-9, 9-11, 11-13, 13-15, 15-17, 17-19 or 19-21 nM, and the affinity of the first antigen-binding polypeptide construct for CD3 expressed on a T cell is in the range of about 5-10, 10-15, 15-20, 20-15, 25-30, 30-35, 35-40, 40-50, 50-55, 55-60, 60-70, 70-80, 80-90 or 90-100 nm, as determined by FACS analysis.

Methods of Preparation of Antigen-Binding Constructs

Antigen-binding constructs described herein may be produced using recombinant methods and compositions, e.g., as described in U.S. Pat. No. 4,816,567.

In one embodiment, an isolated nucleic acid encoding an antigen-binding construct described herein is provided. Such nucleic acid may encode an amino acid sequence comprising the VL and/or an amino acid sequence comprising the VH of the antigen-binding construct (e.g., the light and/or heavy chains of the antigen-binding construct). In a further embodiment, one or more vectors (e.g., expression vectors) comprising such nucleic acid are provided. In one embodiment, the nucleic acid is provided in a multicistronic vector. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antigen-binding construct and an amino acid sequence comprising the VH of the antigen-binding polypeptide construct, or (2) a first vector comprising a nucleic acid that encodes an amino acid sequence comprising the VL of the antigen-binding polypeptide construct and a second vector comprising a nucleic acid that encodes an amino acid sequence comprising the VH of the antigen-binding polypeptide construct. In one embodiment, the host cell is eukaryotic, e.g. a Chinese Hamster Ovary (CHO) cell, or human embryonic kidney (HEK) cell, or lymphoid cell (e.g., Y0, NS0, Sp20 cell). In one embodiment, a method of making an antigen-binding construct is provided, wherein the method comprises culturing a host cell comprising nucleic acid encoding the antigen-binding construct, as provided above, under conditions suitable for expression of the antigen-binding construct, and optionally recovering the antigen-binding construct from the host cell (or host cell culture medium).

For recombinant production of the antigen-binding construct, a nucleic acid encoding an antigen-binding construct, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antigen-binding construct).

Suitable host cells for cloning or expression of antigen-binding construct-encoding vectors include prokaryotic or eukaryotic cells described herein.

A "recombinant host cell" or "host cell" refers to a cell that includes an exogenous polynucleotide, regardless of the method used for insertion, for example, direct uptake, transduction, f-mating, or other methods known in the art to create recombinant host cells. The exogenous polynucleotide may be maintained as a nonintegrated vector, for example, a plasmid, or alternatively, may be integrated into the host genome.

As used herein, the term "eukaryote" refers to organisms belonging to the phylogenetic domain Eucarya such as animals (including but not limited to, mammals, insects, reptiles, birds, etc.), ciliates, plants (including but not limited to, monocots, dicots, algae, etc.), fungi, yeasts, flagellates, microsporidia, protists, etc.

As used herein, the term "prokaryote" refers to prokaryotic organisms. For example, a non-eukaryotic organism can belong to the Eubacteria (including but not limited to, *Escherichia coli, Thermus thermophilus, Bacillus stearothermophilus, Pseudomonas fluorescens, Pseudomonas aeruginosa, Pseudomonas putida*, etc.) phylogenetic domain, or the Archaea (including but not limited to, *Methanococcus jannaschii, Methanobacterium thermoautotrophicum, Halobacterium* such as *Haloferax volcanii* and *Halobacterium* species NRC-1, *Archaeoglobus fulgidus, Pyrococcus furiosus, Pyrococcus horikoshii, Aeuropyrum pernix*, etc.) phylogenetic domain.

For example, antigen-binding constructs may be produced in bacteria, in particular when glycosylation and Fc effector function are not needed. For expression of antigen-binding construct fragments and polypeptides in bacteria, see, e.g., U.S. Pat. Nos. 5,648,237, 5,789,199, and 5,840,523. (See also Charlton, *Methods in Molecular Biology, Vol.* 248 (B.K.C. Lo, ed., Humana Press, Totowa, N.J., 2003), pp. 245-254, describing expression of antibody fragments in *E. coli*.) After expression, the antigen-binding construct may be isolated from the bacterial cell paste in a soluble fraction and can be further purified.

In addition to prokaryotes, eukaryotic microbes such as filamentous fungi or yeast are suitable cloning or expression hosts for antigen-binding construct-encoding vectors, including fungi and yeast strains whose glycosylation pathways have been "humanized," resulting in the production of an antigen-binding construct with a partially or fully human glycosylation pattern. See Gerngross, *Nat. Biotech.* 22:1409-1414 (2004), and Li et al., *Nat. Biotech.* 24:210-215 (2006).

Suitable host cells for the expression of glycosylated antigen-binding constructs are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES™ technology for producing antigen-binding constructs in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., *J. Gen Virol.* 36:59 (1977)); baby hamster kidney cells (BHK); mouse sertoli cells (TM4 cells as described, e.g., in Mather, *Biol. Reprod.* 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., *Annals N.Y. Acad. Sci.* 383:44-68 (1982); MRC 5 cells; and FS4 cells. Other useful mammalian host cell lines include Chinese hamster ovary (CHO) cells, including DHFR-CHO cells (Urlaub et al., *Proc. Natl. Acad. Sci. USA* 77:4216 (1980)); and myeloma cell lines such as Y0, NS0 and Sp2/0. For a review of certain mammalian host cell lines suitable for antigen-binding construct production, see, e.g., Yazaki and Wu, *Methods in Molecular Biology, Vol.* 248 (B.K.C. Lo, ed., Humana Press, Totowa, N.J.), pp. 255-268 (2003).

In one embodiment, the antigen-binding constructs described herein are produced in stable mammalian cells, by a method comprising: transfecting at least one stable mammalian cell with: nucleic acid encoding the antigen-binding construct, in a predetermined ratio; and expressing the nucleic acid in the at least one mammalian cell. In some embodiments, the predetermined ratio of nucleic acid is determined in transient transfection experiments to determine the relative ratio of input nucleic acids that results in the highest percentage of the antigen-binding construct in the expressed product.

If required, the antigen-binding constructs can be purified or isolated after expression. Proteins may be isolated or purified in a variety of ways known to those skilled in the art. Standard purification methods include chromatographic techniques, including ion exchange, hydrophobic interaction, affinity, sizing or gel filtration, and reversed-phase, carried out at atmospheric pressure or at high pressure using systems such as FPLC and HPLC. Purification methods also include electrophoretic, immunological, precipitation, dialysis, and chromatofocusing techniques. Ultrafiltration and diafiltration techniques, in conjunction with protein concentration, are also useful. As is well known in the art, a variety of natural proteins bind Fc and antibodies, and these proteins can find use in the present invention for purification of antigen-binding constructs. For example, the bacterial proteins A and G bind to the Fc region. Likewise, the bacterial protein L binds to the Fab region of some antibodies. Purification can often be enabled by a particular fusion partner. For example, antibodies may be purified using glutathione resin if a GST fusion is employed, $Ni^{+2}$ affinity chromatography if a His-tag is employed, or immobilized anti-flag antibody if a flag-tag is used. For general guidance in suitable purification techniques, see, e.g. incorporated entirely by reference Protein Purification: Principles and Practice, 3rd Ed., Scopes, Springer-Verlag, NY, 1994, incorporated entirely by reference. The degree of purification necessary will vary depending on the use of the antigen-binding constructs. In some instances no purification is necessary.

In certain embodiments the antigen-binding constructs are purified using Anion Exchange Chromatography including, but not limited to, chromatography on Q-sepharose, DEAE sepharose, poros HQ, poros DEAF, Toyopearl Q, Toyopearl QAE, Toyopearl DEAE, Resource/Source Q and DEAE, Fractogel Q and DEAE columns.

In specific embodiments the proteins described herein are purified using Cation Exchange Chromatography including, but not limited to, SP-sepharose, CM sepharose, poros HS, poros CM, Toyopearl SP, Toyopearl CM, Resource/Source S and CM, Fractogel S and CM columns and their equivalents and comparables.

In addition, antigen-binding constructs described herein can be chemically synthesized using techniques known in the art (e.g., see Creighton, 1983, Proteins: Structures and Molecular Principles, W. H. Freeman & Co., N.Y and Hunkapiller et al., Nature, 310:105-111 (1984)). For example, a polypeptide corresponding to a fragment of a polypeptide can be synthesized by use of a peptide synthesizer. Furthermore, if desired, nonclassical amino acids or chemical amino acid analogs can be introduced as a substitution or addition into the polypeptide sequence. Nonclassical amino acids include, but are not limited to, the D-isomers of the common amino acids, 2,4diaminobutyric acid, alpha-amino isobutyric acid, 4aminobutyric acid, Abu, 2-amino butyric acid, g-Abu, e-Ahx, 6amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, □-alanine, fluoro-amino acids, designer amino acids such as □-methyl amino acids, C□-methyl amino acids, N□-methyl amino acids, and amino acid analogs in general. Furthermore, the amino acid can be D (dextrorotary) or L (levorotary).

In some embodiments, the antigen-binding constructs described herein are substantially purified. The term "substantially purified" refers to a construct described herein, or variant thereof that may be substantially or essentially free of components that normally accompany or interact with the protein as found in its naturally occurring environment, i.e. a native cell, or host cell in the case of recombinantly produced antigen-binding construct that in certain embodiments, is substantially free of cellular material includes preparations of protein having less than about 30%, less than about 25%, less than about 20%, less than about 15%, less than about 10%, less than about 5%, less than about 4%, less than about 3%, less than about 2%, or less than about 1% (by dry weight) of contaminating protein. When the antigenbinding construct or variant thereof is recombinantly produced by the host cells, the protein in certain embodiments is present at about 30%, about 25%, about 20%, about 15%, about 10%, about 5%, about 4%, about 3%, about 2%, or about 1% or less of the dry weight of the cells. When the antigen-binding construct or variant thereof is recombinantly produced by the host cells, the protein, in certain embodiments, is present in the culture medium at about 5 g/L, about 4 g/L, about 3 g/L, about 2 g/L, about 1 g/L, about 750 mg/L, about 500 mg/L, about 250 mg/L, about 100 mg/L, about 50 mg/L, about 10 mg/L, or about 1 mg/L or less of the dry weight of the cells. In certain embodiments, a "substantially purified" antigen-binding construct produced by the methods described herein, has a purity level of at least about 30%, at least about 35%, at least about 40%, at least about 45%, at least about 50%, at least about 55%, at least about 60%, at least about 65%, at least about 70%, specifically, a purity level of at least about 75%, 80%, 85%, and more specifically, a purity level of at least about 90%, a purity level of at least about 95%, a purity level of at least about 99% or greater as determined by appropriate methods such as SDS/PAGE analysis, RP-HPLC, SEC, and capillary electrophoresis.

Post-Translational Modifications:

In certain embodiments antigen-binding constructs described herein are differentially modified during or after translation.

The term "modified," as used herein refers to any changes made to a given polypeptide, such as changes to the length of the polypeptide, the amino acid sequence, chemical structure, co-translational modification, or post-translational modification of a polypeptide. The form "(modified)" term means that the polypeptides being discussed are optionally modified, that is, the polypeptides under discussion can be modified or unmodified.

The term "post-translationally modified" refers to any modification of a natural or non-natural amino acid that occurs to such an amino acid after it has been incorporated into a polypeptide chain. The term encompasses, by way of example only, co-translational in vivo modifications, co-translational in vitro modifications (such as in a cell-free translation system), post-translational in vivo modifications, and post-translational in vitro modifications.

In some embodiments, the modification is at least one of: glycosylation, acetylation, phosphorylation, amidation, derivatization by known protecting/blocking groups, proteolytic cleavage and linkage to an antibody molecule or antigen-binding construct or other cellular ligand. In some embodiments, the antigen-binding construct is chemically modified by known techniques, including but not limited, to specific chemical cleavage by cyanogen bromide, trypsin, chymotrypsin, papain, V8 protease, NaBH4; acetylation, formylation, oxidation, reduction; and metabolic synthesis in the presence of tunicamycin.

Additional post-translational modifications of antigen-binding constructs described herein include, for example, N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of procaryotic host cell expression. The antigen-binding constructs described herein are modified with a detectable label, such as an enzymatic, fluorescent, isotopic or affinity label to allow for detection and isolation of the protein. In certain embodiments, examples of suitable enzyme labels include horseradish peroxidase, alkaline phosphatase, beta-galactosidase, or acetylcholinesterase; examples of suitable prosthetic group complexes include streptavidin biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include iodine, carbon, sulfur, tritium, indium, technetium, thallium, gallium, palladium, molybdenum, xenon, fluorine.

In some embodiments, antigen-binding constructs described herein are attached to macrocyclic chelators that associate with radiometal ions.

In some embodiments, the antigen-binding constructs described herein are modified by either natural processes, such as post-translational processing, or by chemical modification techniques which are well known in the art. In certain embodiments, the same type of modification may be present in the same or varying degrees at several sites in a given polypeptide. In certain embodiments, polypeptides from antigen-binding constructs described herein are branched, for example, as a result of ubiquitination, and in some embodiments are cyclic, with or without branching. Cyclic, branched, and branched cyclic polypeptides are a result from posttranslation natural processes or made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POST-TRANSLATIONAL COVALENT MODIFICATION OF PROTEINS, B. C. Johnson, Ed., Academic Press, New York, pgs. 1-12 (1983); Seifter et al., Meth. Enzymol. 182:626-646 (1990); Rattan et al., Ann. N.Y. Acad. Sci. 663:48-62 (1992)).

In certain embodiments, antigen-binding constructs described herein are attached to solid supports, which are particularly useful for immunoassays or purification of polypeptides that are bound by, that bind to, or associate with proteins described herein. Such solid supports include, but are not limited to, glass, cellulose, polyacrylamide, nylon, polystyrene, polyvinyl chloride or polypropylene.

Functional Activity of Drug-Conjugated Antigen-Binding Constructs and Assays to Measure Function The antigen-binding constructs described herein can be assayed for functional activity (e.g., biological activity) using or routinely modifying assays known in the art, as well as assays described herein.

Methods of testing the biological activity of the antigen-binding constructs and drug-conjugated antigen-binding constructs described herein can be measured by various assays as described in the Examples. Such methods include in vitro assays measuring T cell-mediated killing of target cells bearing the target antigen that is specifically bound by the second antigen-binding polypeptide construct. For example, the killing of target cells bearing the relevant target antigens can be measured in cultures comprising human whole blood, PBMCs, or PBMCs from which the B cells have been removed, referred to herein as "PBMC-B) as a source of effector T cells. Such assays may also be carried out using purified T cell cultures. This type of assay detects both T-cell mediated killing of target cells bearing the target antigen and any killing that occurs through internalization of the drug-conjugated construct by the target cells. Thus in some embodiments described herein, the killing potency of a drug-conjugated antigen-binding construct such as an anti-CD3-CD19, CD3-CDH3, CD3-HER2, CD3-HER3 OR CD3-EGFR against a target cell bearing the target antigen is observed to be higher than the reference unconjugated construct. In some embodiments, the drug-conjugated antigen-binding constructs described herein display increased Raji or Ramos tumor B cell killing compared to a reference unconjugated antigen-binding construct having the same CDRs and binding affinity.

The direct cytoxicity of a drug-conjugated antigen-binding construct may be determined by culturing the construct with a target cell bearing the target antigen to which the second antigen-binding polypeptide construct is directed. In some embodiments described herein, the target antigen is CD19, HER2, HER3, EGFR or CDH3, and the cytoxicity is determined by culturing the construct with target cells bearing the relevant target antigen, for example, as described in Example 22. In this type of assay, it is possible to assess whether cell killing by means of internalization of the drug, in the absence of any T-cell mediated killing.

The impact of the drug-conjugated antigen-binding construct on T cells can be measured in several ways. The internalization of the construct into T cells can be measured by coupling a dye or other detectable agent to the construct, and culturing it with T cells and monitoring the amount of dye that accumulates in the T cell, for example, as described in Example 21, in which Jurkat T cells were used. This can be compared in the same experiment with the internalization of the construct into target cells bearing the target antigen. In some embodiments described herein, the internalization of the drug-conjugated construct into T cells is lower than into target cells bearing the target antigen. In some embodiments, the internalization into T cells is at least 10, 20, 30, 40, 50, 60, 70, 80, 90 or 100-fold lower than internalization into target cells bearing target antigen. In some embodiments, the T cell is a Jurkat cell. In some embodiments the target antigen is EGFR and the construct is internalized at least 10-50-fold more into target cells than T cells. In some embodiments the target antigen is EGFR and the construct is internalized at least 10-50-fold more into target cells than Jurkat T cells. In some embodiments the target antigen is CDH3 and the construct is internalized at least 10-50-fold more into target cells than Jurkat T cells. In some embodiments the target antigen is CD19 and the construct is internalized at least 10-50-fold more into target cells than Jurkat T cells.

The impact of the drug-conjugated antigen-binding constructs on T cells can also be assessed by culturing T cells from human blood (PBMC) with the constructs, with or without target cells bearing the target antigen, and analyzing the resulting T cell subpopulations in the culture using FACS to detect T cell surface markers PD1, CD4, CD8, CD25, CD69 and CD45. In some embodiments, the assay is carried out as in Examples 14, 15 or 16. In some embodiments, the construct does not increase the number of inhibitory PD1+ cells. In some embodiments, an anti-CD3-CD19-drug conjugate causes less activation of inhibitory (PD-1+) T cells than blinatumomab.

In some embodiments, the drug-conjugated antigen-binding constructs display killing of Raji or Ramos tumor B cell with high potency, and killing of Jurkat tumor T cells with low potency. In some embodiments, the potency of the drug-conjugated antigen-binding constructs is at least 1.5, 2, 4, 6, 8, 10, 15, 20, 25, 30, 35, 40, 45, 50 or more-fold higher on B cells than on T cells. In a specific embodiment, the potency of a CD3-CD19 antigen-binding construct on Ramos B cells is about 0.5 nM, and the potency on T cells is about 23 nM. In some embodiments, the potency on target cells is at least 2-fold higher than on T cells. In another embodiment, the potency on target cells is at least 4-fold higher than on T cells. In another embodiment, the potency on target cells is at least 6-fold higher than on T cells. In another embodiment, the potency on target cells is at least 8-fold higher than on T cells. In another embodiment, the potency on target cells is at least 10-fold higher than on T cells. In another embodiment, the potency on target cells is at least 15-fold higher than on T cells.

In some embodiments, the drug-conjugated antigen-binding construct have a cleavable linker and do not reduce the number of T cells in an assay compared to a reference construct with a non-cleavable linker or a reference construct that is not conjugated to a drug.

The impact of the drug-conjugated antigen-binding constructs on T cells can also be evaluated in vivo, as was done in Examples 18 and 19. In some embodiments, the drug-conjugated antigen-binding constructs did not reduce the number of circulating T cells or the number of splenic T cells in a humanized NSG mouse when administered at doses ranging from 0.1 mg/kg to 3.0 mg/kg. In some embodiments the construct tested was an anti-CD3-CD19-drug conjugate. In some embodiments, the drug-conjugated antigen-binding construct does not substantially impact the level of CD45+/CD8+ T cells in the peripheral blood of humanized NSG mice over a 5-day period.

In some embodiments, anti-CD3-CD19 antigen-binding constructs described herein are capable of synapse formation and bridging between CD19+ Raji B-cells and Jurkat T-cells as assayed by FACS and/or microscopy. In some embodiments, the drug-conjugated antigen-binding constructs described herein display less activation of inhibitory (PD-1+) T cells than blinatumomab.

In certain embodiments, the assays are those described in the examples below.

In some embodiments, the functional characteristics of the bi-specific antigen-binding constructs described herein are compared to those of a reference antigen-binding construct. The identity of the reference antigen-binding construct depends on the functional characteristic being measured or the distinction being made. For example, when comparing the functional characteristics of exemplary anti-CD3-CD19bi-specific antigen-binding constructs, the reference antigen-binding construct may be the anti CD19 antibody HD37 and/or the anti CD3 antibodies OKT3 or teplizumab. In other embodiment, the reference antigen-binding construct is a construct described herein, e.g., v891 (blinatumomab) or bivalent anti-CD19 (v4371). In some embodiments, the reference antigen-binding construct is the same variant without a conjugated drug, for example, comparing v12043 with v12043 conjugated to DM1 with an SMCC linker.

The degree to which an antibody blocks binding to a reference antibody, for example, OKT3 or HD37 can be assessed using a competition assay in which the test antibody is able to inhibit or block specific binding of the OKT3 or HD37 antibody (reference antibody) to its target antigen (see, e.g., Junghans et al., Cancer Res. 50:1495, 1990; Fendly et al. Cancer Research 50: 1550-1558; U.S. Pat. No. 6,949,245 for examples of assays). A test antibody competes with a reference antibody if an excess of a test antibody (e.g., at least 2×, 5×, 10×, 20×, or 100×) inhibits or blocks binding of the reference antibody by, e.g., at least 50%, 60%, 70%, 75%, 80%, 85%, 90%, 95%, or 99% as measured in a competitive binding assay. Test antibodies identified by competition assay (blocking antibodies) include those binding to the same epitope as the reference antibody and antibodies binding to an adjacent epitope sufficiently proximal to the epitope bound by the reference antibody for steric hindrance to occur.

For example, in one embodiment where one is assaying for the ability of a antigen-binding construct described herein to bind an antigen or to compete with another polypeptide for binding to an antigen, or bind to an Fc receptor and/or anti-albumin antibody, various immunoassays known in the art can be used, including but not limited to, competitive and non-competitive assay systems using techniques such as radioimmunoassays, ELISA (enzyme linked immunosorbent assay), "sandwich" immunoassays, immunoradiometric assays, gel diffusion precipitation reactions, immunodiffusion assays, in situ immunoassays (using colloidal gold, enzyme or radioisotope labels, for example), western blots, precipitation reactions, agglutination assays (e.g., gel agglutination assays, hemagglutination assays), complement fixation assays, immunofluorescence assays, protein A assays, and immunoelectrophoresis assays, etc. In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention.

In certain embodiments, where a binding partner (e.g., a receptor or a ligand) is identified for an antigen-binding domain comprised by a antigen-binding construct described herein, binding to that binding partner by an antigen-binding construct described herein is assayed, e.g., by means well-known in the art, such as, for example, reducing and non-reducing gel chromatography, protein affinity chromatography, and affinity blotting. See generally, Phizicky et al., Microbiol. Rev. 59:94-123 (1995). In another embodiment, the ability of physiological correlates of a antigen-binding construct protein to bind to a substrate(s) of antigen-binding polypeptide constructs of the antigen-binding constructs described herein can be routinely assayed using techniques known in the art.

Antigen-Binding Construct Drug Conjugates (ADCs)

In many embodiments provided herein antigen binding constructs are conjugated to a drug, e.g., a toxin, a chemotherapeutic agent, a small molecule therapeutic, an immune modulator e.g. a cytokine, or a radioisotope. Numerous methods of preparing ADCs (antibody drug conjugates or antigen binding construct drug conjugates) are known in the art and are described in U.S. Pat. No. 8,624,003 (pot method), U.S. Pat. No. 8,163,888 (one-step), and U.S. Pat. No. 5,208,020 (two-step method) for example.

In some embodiments, the drug is selected from a maytansine, auristatin, calicheamicin, or derivative thereof. In other embodiments, the drug is a maytansine selected from DM1 and DM4. Further examples are described below.

In certain embodiments, the antigen binding construct is conjugated to a drug via a linker. The linker may be cleavable or non-cleavable. Non-limiting examples of linkers are described below.

In some embodiments, one molecule of drug is conjugated to an antigen-binding construct, but in others, multiple drug molecules may be conjugated to the same antigen-binding construct. The drug-to-antigen binding construct ratio (DAR) can be, e.g., in the range of 1.0 to 6.0, or 3.0 to 5.0, or 2.0 to 4.0. In some embodiments described herein, the DAR ranges from 2.2 to 3.5. In some embodiments, the DAR is 1.0, 2.0, 3.0, 4.0, 5.0, 6.0, 7.0 or 8.0.

In certain embodiments, the ADCs have the general formula I:

$$A\text{-}(L\text{-}(D)_m)_n \qquad (I)$$

where A is an antigen binding construct as described herein; L is a linker; D is a drug; m is an integer between 1 and about 10, and n is an integer between 1 and about 20. In certain embodiments, m is between about 1 and about 5, or between 1 and 2. In some embodiments, m is 1. In some embodiments, n is between 1 and 10, for example, between 1 and 8, between 2 and 8, between 2 and 6, or between 2 and 4. In some embodiments, L may be absent.

Drugs

The drug moiety of the ADCs may be a compound or moiety having a cytostatic or cytotoxic effect. In some embodiments the antigen-binding construct is conjugated to a cytotoxic agent. The term "cytotoxic agent" as used herein refers to a substance that inhibits or prevents the function of cells and/or causes destruction of cells. The term is intended to include radioactive isotopes (e.g. $^{211}$At, $^{131}$I, $^{125}$I, $^{90}$Y, $^{186}$Re, $^{188}$Re, $^{153}$Sm, $^{212}$Bi, $^{32}$P and $^{177}$Lu), chemotherapeutic agents, and toxins such as small molecule toxins or enzymatically active toxins of bacterial, fungal, plant or animal origin, including fragments and/or variants thereof. One skilled in the art will appreciate that some of these categories of drugs overlap and are thus not intended to be mutually exclusive. For example, toxins may also be considered as chemotherapeutic agents in the sense that they are chemical compounds that may be used to treat cancer. In some embodiments, the drug is an analogue or derivative of a naturally occurring toxin. Examples of such naturally occurring toxins include, but are not limited to, maytansines, auristatins, dolastatins, tubulysins, hemiasterlins, calicheamicins, duocarmycins, pyrrolobenzodiazapenes, amatoxins, camptothecins, *Pseudomonas* exotoxin (PE), diphtheria toxin (DT), deglycosylated ricin A (dgA) and gelonin. In some embodiments, the drug is an analogue or derivative of a naturally occurring toxin having a peptidyl scaffold. Non-limiting examples of such toxins include auristatins, dolastatins, tubulysins, hemiasterlins and amatoxins.

In certain embodiments, the drug comprised by the ADCs is a toxin, or a toxin derivative or analogue, where the toxin, derivative or analogue is a microtubule disrupting agent or a DNA modifying agent. Examples of toxins that are microtubule disrupting agents include, but are not limited to, maytansines, auristatins, dolastatins, tubulysins, hemiasterlins, and analogues and derivatives thereof. Examples of toxins that are DNA modifying agents include, but are not limited to, calicheamicins and other enediyne antibiotics, duocarmycins, pyrrolobenzodiazapenes, amatoxins, camptothecins, and analogues and derivatives thereof.

Maytansines

As indicated above, in some embodiments the drug is a maytansine or maytansine analogue or derivative ("maytansinoid"). Exemplary maytansinoids include DM1 (mertansine, emtansine, $N_2$'-deacetyl-$N_2$'-(3-mercapto-1-oxopropyl)maytansine), DM3 ($N_2$'-deacetyl-$N_2$'-(4-mercapto-1-oxopentyl)maytansine), and DM4 (ravtansine, soravtansine, $N^{2'}$-deacetyl-$N_2$'-(4-methyl-4-mercapto-1-oxopentyl)maytansine) (see U.S. Patent Publication No. US 2009/0202536). Other examples of naturally occurring, synthetic and semi-synthetic maytansinoids are described in Cassady et al., (2004) *Chem. Pharm. Bull.* 52(1):1-26, and in U.S. Pat. Nos. 4,256,746; 4,361,650; 4,307,016; 4,294,757; 4,424,219; 4,331,598; 4,364,866; 4,313,946; 4,315,929; 4,362,663; 4,322,348 and 4,371,533. Many positions on maytansine compounds are known to be useful as the linkage position, depending upon the type of link. For example, for forming an ester linkage, the C-3 position having a hydroxyl group, the C-14 position modified with hydroxymethyl, the C-15 position modified with a hydroxyl group and the C-20 position having a hydroxyl group are all suitable.

In certain embodiments, the drug included in the ADC is a maytansinoid having the general formula (II):

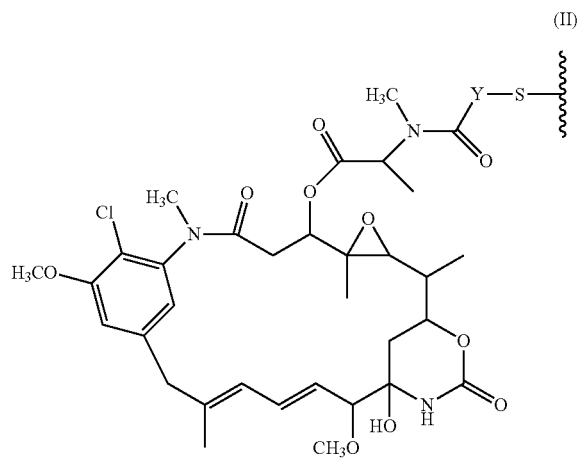

(II)

where Y is —(CR2)$_m$—, each R is independently H or $C_1$-$C_6$ alkyl, m is 1, 2 or 3, and ∿ indicates the point of attachment to linker L (see U.S. Pat. No. 5,208,020, RE39151, WO 2007/056550 and Widdison et al., (2006) *J. Med. Chem.*, 49:4392-4408).

In some embodiments, the drug included in the ADC is a maytansinoid having the general formula (II) in which Y is —CH$_2$CH$_2$—, —CH$_2$CH$_2$CH(CH$_3$)— or —CH$_2$CH$_2$C(CH$_3$)$_2$. All stereoisomers of the maytansine drug moiety are contemplated for the ADCs described herein, i.e. any combination of R and S configurations at the chiral carbons.

In some embodiments, the drug included in the ADC is a maytansinoid having the following stereochemistry (general formula (IIA)):

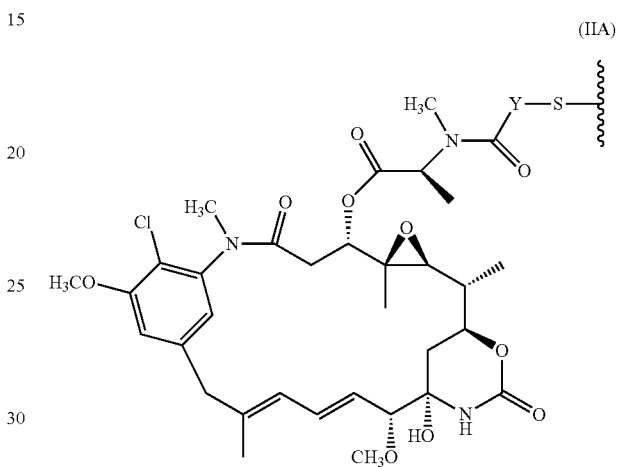

(IIA)

where Y is as defined above for general formula (II).

In some embodiments, the drug included in the ADC is a maytansinoid having the general formula (II) or (IIA) in which Y is —CH$_2$CH$_2$— (e.g. DM1), —CH$_2$CH$_2$CH(CH$_3$)— (e.g. DM3) or —CH$_2$CH$_2$C(CH$_3$)$_2$— (e.g. DM4). In some embodiments, the drug included in the ADC is a maytansinoid having the general formula (II) or (IIA) in which Y is —CH$_2$CH$_2$— (e.g. DM1) or —CH$_2$CH$_2$C(CH$_3$)$_2$— (e.g. DM4).

Dolastatins and Auristatins

In some embodiments, the drug is a dolastatin or an auristatin, such as auristatin E (also known in the art as a derivative of dolastatin-10) or auristatin F, or an analogue or derivative thereof. The auristatin can be, for example, an ester formed between auristatin E and a keto acid. For example, auristatin E can be reacted with paraacetyl benzoic acid or benzoylvaleric acid to produce auristatin EB (AEB) and auristatin EVB (AEVB), respectively. Other typical auristatins include auristatin F phenylenediamine (AFP), monomethylauristatin F (MMAF), and monomethylauristatin E (MMAE). The synthesis and structure of exemplary auristatins are described in U.S. Pat. Nos. 6,884,869; 7,098,308; 7,256,257; 7,423,116; 7,498,298 and 7,745,394, each of which is incorporated by reference herein in its entirety and for all purposes.

The dolastatin or auristatin may be conjugated to the antigen binding construct via the amino (N)-terminus or the carboxy (C)-terminus of the drug molecule. In some embodiments, the drug is an auristatin or analogue or derivative thereof and is conjugated to the antigen binding construct via the N-terminus of the drug molecule. Examples of auristatin analogues suitable for conjugation via the N-terminus of the drug molecule include those described in U.S. Pat. Nos. 7,498,298 and 7,659,241.

In some embodiments, the drug is MMAE or MMAF. In some embodiments, the drug is MMAE or MMAF and is conjugated to the antigen binding construct via the N-terminus of the drug molecule as shown below, where indicates the point of attachment to linker L:

"cycloalkyl-alkyl" refers to an alkyl group substituted with one cycloalkyl substituent; the term "heteroaryl" refers to a radical derived from a 6- to 12-membered mono- or bicyclic ring system wherein at least one ring atom is a heteroatom, such as O, N or S, and at least one ring is aromatic; the term

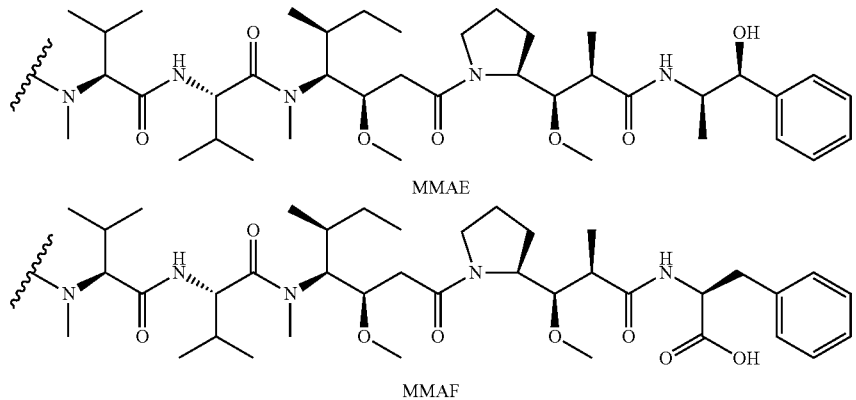

MMAE

MMAF

In some embodiments, the drug is an auristatin or analogue or derivative thereof and is conjugated to the antigen binding construct via the C-terminus of the drug molecule. Examples of auristatin analogues suitable for conjugation via the C-terminus of the drug molecule include those described in International Patent Publication Nos. WO 2002/088172 and WO 2016/041082.

In some embodiments, the drug is an auristatin of general formula (III):

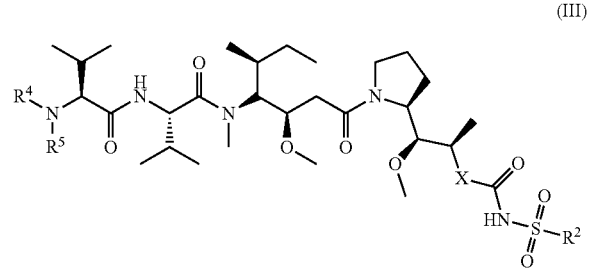

(III)

wherein:
$R^2$ is selected from $C_2$-$C_6$ alkyl, aryl, aryl-$C_1$-$C_6$ alkyl, $C_4$-$C_7$ cycloalkyl, $C_3$-$C_7$ cycloalkyl-$C_1$-$C_6$ alkyl, heteroaryl, heteroaryl-$C_1$-$C_6$ alkyl and heterocyclyl, each optionally substituted with one or more substituents selected from $C_1$-$C_6$ alkoxy, $C_1$-$C_6$ alkoxycarbonyl, $C_1$-$C_6$ alkyl, $C_1$-$C_6$alkylamino, amino, amino-$C_1$-$C_6$ alkyl, amino-aryl, amino-$C_3$-$C_7$ cycloalkyl, carboxamide, carboxyl, cyano, $C_1$-$C_6$ haloalkyl, $C_1$-$C_6$ haloalkoxy, halo, hydroxyl, nitro, thio and thio-$C_1$-$C_6$ alkyl;
X is —C(O)NHCH(CH$_2$R$^3$)—, or X is absent;
$R^3$ is selected from aryl, heteroaryl and $C_3$-$C_7$ cycloalkyl, each optionally substituted with one substituent selected from amino and hydroxyl, and
$R^4$ and $R^5$ are each independently H or $C_1$-$C_6$ alkyl.
In the context of general formula (III), the term "aryl" refers to a radical derived from a 6- to 12-membered mono- or bicyclic hydrocarbon ring system in which at least one ring is aromatic; the term "aryl-alkyl" refers to an alkyl group substituted with one aryl substituent; the term "heteroaryl-alkyl" refers to an alkyl group substituted with one heteroaryl substituent; the term "heterocyclyl" refers to a radical derived from a 3- to 12-membered mono- or bicyclic non-aromatic ring system wherein at least one ring atom is a heteroatom such as O, N or S; the term "alkoxycarbonyl" refers to —C(O)O-alkyl; the term "alkylamino" refers to —NH-alkyl; the term "amino-alkyl" refers to an alkyl group substituted with one amino substituent; the term "amino-aryl" refers to an aryl group substituted with one amino substituent; the term "amino-cycloalkyl" refers to a cycloalkyl group substituted with one amino substituent; the term "carboxamide" refers to —C(O)NH2; the term "haloalkyl" refers to an alkyl group substituted with one or more halo substituents; the term "haloalkoxy" refers to —O-haloalkyl, and the term "thio-alkyl" refers to —S-alkyl.

In certain embodiments, the drug is an auristatin of general formula (III) and is conjugated to the antigen binding moiety via the $R^2$ group.

Tubulysins

In some embodiments, the drug is a tubulysin. Naturally occurring tubulysins include, for example, tubulysins A, B, C, D, E, F, G, H, I, U, V, W and Z:

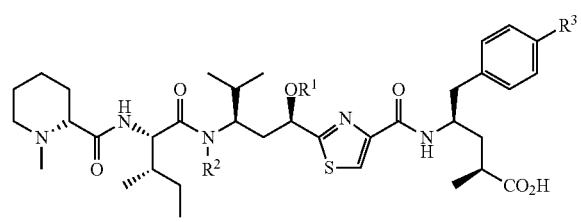

Tubulysin A: $R^1$=Ac; $R^2$=CH$_2$OC(O)CH$_2$CH(CH$_3$)$_2$; $R^3$=OH
Tubulysin B: $R^1$=Ac; $R^2$=CH$_2$OC(O)CH$_2$CH$_2$CH$_3$; $R^3$=OH
Tubulysin C: $R^1$=Ac; $R^2$=CH$_2$OC(O)CH$_2$CH$_3$; $R^3$=OH
Tubulysin D: $R^1$=Ac; $R^2$=CH$_2$OC(O)CH$_2$CH(CH$_3$)$_2$; $R^3$=H
Tubulysin E: $R^1$=Ac; $R^2$=CH$_2$OC(O)CH$_2$CH$_2$CH$_3$; $R^3$=H Tubulysin F: $R^1$=Ac; $R^2$=CH$_2$OC(O)CH$_2$CH$_3$; $R^3$=H
Tubulysin G: $R^1$=Ac; $R^2$=CH$_2$OC(O)CH=C(CH$_3$)$_2$; $R^3$=OH
Tubulysin H: $R^1$=Ac; $R^2$=CH$_2$OC(O)CH$_3$; $R^3$=H
Tubulysin I: $R^1$=Ac; $R^2$=CH$_2$OC(O) CH$_3$; $R^3$=OH
Tubulysin U: $R^1$=Ac; $R^2$=$R^3$=H
Tubulysin V: $R^1$=$R^2$=$R^3$=H
Tubulysin W: $R^1$=H; $R^2$=CH$_2$OC(O)CH$_2$CH$_2$CH$_2$; $R^3$=OH
Tubulysin X: $R^1$=Ac; $R^2$=H; $R^3$=OH
Tubulysin Z: $R^1$=$R^2$=H; $R^3$=OH Therapeutically useful analogues and derivatives of tubulysins have also been described (see, for example, International Patent Publication No. WO 2014/126836 and U.S. Patent Publication No. US 2016/0130299).

The tubulysin or tubulysin analogue or derivative may be conjugated to the antigen binding construct through a free hydroxyl group, or it may be modified to include an amine group that can be used for conjugation as described in U.S. Patent Publication US 2016/0130299.

Hemiasterlins

In some embodiments, the drug is a hemiasterlin or analogue or derivative thereof. Various analogues and derivatives of hemiasterlin having anti-mitotic activity have been described (see, for example, International Patent Publication Nos. WO 1996/33211 and WO 2004/026293). U.S. Pat. No. 7,579,323 describes an analogue of hemiasterlin, referred to as HTI-286, that possesses potent anti-mitotic activity and which has been assessed in clinical trials for the treatment of cancer. In certain embodiments, the drug is HTI-286 or a derivative thereof:

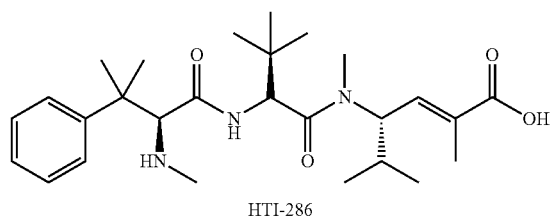

HTI-286

Additional examples of hemiasterlin analogues are described in International Patent Publication No. WO 2014/144871.

In certain embodiments, the drug is a hemiasterlin analogue or derivative having general formula (IV):

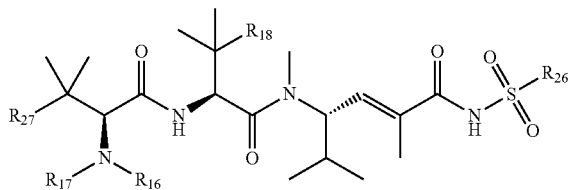

(IV)

wherein:
$R_{26}$ is selected from optionally substituted alkyl, optionally substituted alkylamino, optionally substituted cycloalkyl, optionally substituted aryl, optionally substituted heterocyclyl and optionally substituted heteroaryl;
$R_{27}$ is selected from optionally substituted alkyl, optionally substituted alkylamino, optionally substituted cycloalkyl, optionally substituted aryl, optionally substituted heterocyclyl and optionally substituted heteroaryl;
$R_{16}$ and $R_{17}$ are each independently H or C$_{1-6}$ alkyl, and $R_{18}$ is C$_{1-6}$ alkyl or —SH.

In the context of general formula (IV), the term "alkyl" refers to a straight or branched chain substituent consisting solely of carbon and hydrogen atoms, which is saturated or unsaturated and has from one to 12 carbon atoms; the term "alkylamino" refers to a substituent of the formula —NHR$_a$ or —NR$_a$R$_a$, where each R$_a$ is independently an alkyl substituent containing one to 12 carbon atoms; the term "cycloalkyl" refers to a stable non-aromatic monocyclic or polycyclic hydrocarbon substituent consisting solely of carbon and hydrogen atoms, which may include fused or bridged ring systems, having from 3 to 10 carbon atoms; the term "aryl" refers to a hydrocarbon ring substituent comprising hydrogen, 6 to 18 carbon atoms and at least one aromatic ring; the term "heterocyclyl" refers to a stable 3- to 18-membered non-aromatic ring substituent which consists of 2 to 12 carbon atoms and from one to 6 heteroatoms selected from N, O and S, and the term "heteroaryl" refers to a 5- to 14-membered ring system substituent comprising hydrogen atoms, one to 13 carbon atoms, one to 6 heteroatoms selected from N, O and S, and at least one aromatic ring.

In certain embodiments, the drug is a hemiasterlin of general formula (IV) and is conjugated to the antigen binding construct via the $R_{26}$ substituent. In some embodiments, the drug is a hemiasterlin of general formula (IV) and is conjugated to the antigen binding construct via the $R_{27}$ substituent.

Calicheamicins

In some embodiments, the drug is a calicheamycin or analogue or derivative thereof. Various analogues and derivatives of calicheamycin suitable for conjugation to an antigen binding construct have been described (see, for example, International Patent Publication No. WO 2015/063680, U.S. Pat. Nos. 5,773,001; 5,714,586 and 5,770,701).

Duocarmycins

In some embodiments, the drug is a duocarmycin or analogue or derivative thereof. Naturally-occurring duocarmycins include, for example, duocarmycins A, B1, B2, C1, C2, D and SA, as well as CC-1065. Various analogues and derivatives of duocarmycins have been described, including adozelesin, bizelesin and centanamycin. Other analogues and derivatives are described in U.S. Pat. Nos. 4,912,227; 5,070,092; 5,084,468; 5,332,837; 5,641,780; 5,739,350 and 8,889,868. Various groups on the duocarmycin molecule may be modified to allow for conjugation to an antigen binding construct. A non-limiting example is provided in Elgersma et al., (2015) *Mol. Pharmaceutics,* 12:1813-1835.

Pyrrolobenzodiazapenes

In some embodiments, the drug is a pyrrolobenzodiazapene (PBD) or an analogue or derivative thereof, such as a PBD dimer. Various PBD dimers have been described including, for example, those described in U.S. Pat. Nos. 6,884,799; 7,049,311; 7,511,032; 7,528,126; 7,557,099 and 9,056,914. In some embodiments, the drug is a PBD dimer or an analogue or derivative thereof. The PBD dimer structure is believed to improve the fit at the binding site of DNA. PBD dimers may be conjugated to the antigen binding construct through one of a number of potential linkage sites on the PBD dimer, such as the five-membered pyrrolo ring, the tether between the PBD units, the N10-C11 imine group or the C$_2$ position (see, for example, International Patent Publication Nos. WO 2007/085930, WO 2009/016516, WO 2011/130598, WO 2011/130613 and WO 2011/130616; U.S. Patent Publication No. US 2011/0256157).

Amatoxins

In some embodiments, the drug is an amatoxin, such as α-Amanitin, β-Amanitin, γ-Amanitin or ε-Amanitin, or an analogue or derivative thereof. In some embodiments, the drug is α-Amanitin or an analogue or derivative thereof. Amatoxins are cyclic peptides composed of eight amino acids and thus present a number of potential sites for conjugation. Various amatoxins and analogues thereof have been described (see, for example, European Patent No. EP 1 859 811, U.S. Pat. No. 9,233,173 and International Patent Publication No. WO 2014/043403).

Camptothecins

In some embodiments, the drug is a camptothecin (CPT) or analogue or derivative thereof, such as irinotecan (CPT-11), SN-38 (7-ethyl-10-hydroxy-camptothecin), 10-hydroxy camptothecin, topotecan, lurtotecan, 9-aminocamptothecin or 9-nitrocamptothecin. Other examples of CPT analogues and derivatives include 7-butyl-10-amino-camptothecin and 7-butyl-9-amino-10,11-methylenedioxy-camptothecin (see U.S. Patent Publication No. US 2005/0209263) and aniline containing derivatives of these compounds as described in Burke et al., (2009), *Bioconj. Chem.* 20(6):1242-1250. Conjugation of camptothecin and its analogues or derivatives to the antigen binding construct may be achieved via modification of various groups in the drug molecule. Non-limiting examples are provided in Burke et al., (2009), *Bioconj. Chem.* 20(6):1242-1250 and Sharkey et al., (2012) *Mol. Cancer Ther.* 11:224-234.

Chemotherapeutic Agents

In some embodiments the antigen binding construct is conjugated to a chemotherapeutic agent. Examples include but are not limited to cisplatin and Lapatinib. A "chemotherapeutic agent" is a chemical compound useful in the treatment of cancer.

Examples of chemotherapeutic agents include alkylating agents such as thiotepa and cyclosphosphamide (CYTOXAN™); alkyl sulfonates such as busulfan, improsulfan and piposulfan; aziridines such as benzodopa, carboquone, meturedopa, and uredopa; ethylenimines and methylamelamines including altretamine, triethylenemelamine, triethylenephosphoramide, tri ethylenethiophosphaoramide and trimethylolomelamine; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, 5-FU; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elfornithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK7; razoxane; sizofiran; spirogermanium; tenuazonic acid; triaziquone; 2',2', 2'-trichlorotriethylamine; urethan; vindesine; dacarbazine; mannomustine; mitobronitol; mitolactol; pipobroman; gacytosine; arabinoside ("Ara-C"); cyclophosphamide; taxanes, e.g. paclitaxel (TAXOL®, Bristol-Myers Squibb Oncology, Princeton, N.J.) and doxetaxel (TAXOTERE®, Rhone-Poulenc Rorer, Antony, France); chlorambucil; gemcitabine; 6-thioguanine; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; CPT-11; topoisomerase inhibitor RFS 2000; difluoromethylornithine (DMFO); retinoic acid; esperamicins; capecitabine; and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone, and toremifene (Fareston); and anti-androgens such as flutamide, nilutamide, bicalutamide, leuprolide, and goserelin; and pharmaceutically acceptable salts, acids or derivatives of any of the above.

In some embodiments, the chemotherapeutic agent is an anthracycline, such as doxorubicin, epirubicin, idarubicin, daunorubicin (also known as daunomycin), nemorubicin or an analogue or derivative thereof. Various groups within the anthracycline molecule may be modified for conjugation to the antigen binding construct. For example, derivatization of daunorubicin and doxorubicin for conjugation to antibodies has been described (see, for example, Kratz et al., (2006) Current Med. Chem. 13:477-523; U.S. Pat. No. 6,630,579).

Linkers

In some embodiments, the drug is linked to the antigen binding construct, e.g., antibody, by a linker. Linkers are bifunctional or multifunctional moieties capable of linking one or more drugs to the antigen binding construct. In some embodiments, the linker may be bifunctional (or monovalent) such that it links a single drug to a single site on the antigen binding construct. In some embodiments, the linker may be multifunctional (or polyvalent) such that it links more than one drug to a single site on the antigen binding construct. Multifunctional linkers may also be used to link one drug to more than one site on the antigen binding construct in some embodiments.

Attachment of a linker to an antibody or other antigen binding construct can be accomplished in a variety of ways, such as through surface lysines, reductive-coupling to oxidized carbohydrates, and through cysteine residues liberated by reducing interchain disulfide linkages. Alternatively, attachment of a linker to an antigen binding construct may be achieved by modification of the antigen binding construct to include additional cysteine residues (see, for example, U.S. Pat. Nos. 7,521,541; 8,455,622 and 9,000,130) or non-natural amino acids that provide reactive handles, such as selenomethionine, p-acetylphenylalanine, formylglycine or p-azidomethyl-L-phenylalanine (see, for example, Hofer et al., (2009) *Biochemistry* 48:12047-12057; Axup et al., (2012) PNAS 109:16101-16106; Wu et al., (2009) PNAS 106:3000-3005; Zimmerman et al., (2014) Bioconj. Chem. 25:351-361), to allow for site-specific conjugation.

The linkers include a functional group capable of reacting with the target group or groups on the antigen binding construct and one or more functional groups capable of reacting with a target group on the drug. Suitable functional groups are known in the art and include those described, for example, in Bioconjugate Techniques (G. T. Hermanson, 2013, Academic Press). Non-limiting examples of functional groups for reacting with free cysteines or thiols include maleimide, haloacetamide, haloacetyl, activated esters such as succinimide esters, 4-nitrophenyl esters, pentafluorophenyl esters, tetrafluorophenyl esters, anhydrides, acid chlorides, sulfonyl chlorides, isocyanates, and isothiocyanates. Also useful in this context are "self-stabilizing" maleimides as described in Lyon et al., (2014) Nat. Biotechnol. 32:1059-1062. Non-limiting examples of functional groups for reacting with surface lysines and amines include activated esters such as N-hydroxysuccinamide (NHS) esters or sulfo-NHS esters, imido esters such as Traut's reagent, isothiocyanates, aldehydes and acid anhydrides such as diethylenetriaminepentaacetic anhydride (DTPA). Other examples include succinimido-1,1,3,3-tetra-methyluronium tetrafluoroborate (TSTU) and benzotriazol-1-yl-oxytripyrrolidinophosphonium hexafluorophosphate (PyBOP). Non-limiting examples of functional groups capable of reacting with an electrophilic group on the antigen binding construct or drug (such as an aldehyde or ketone carbonyl group) include hydrazide, oxime, amino, hydrazine, thiosemicarbazone, hydrazine carboxylate and arylhydrazide.

In certain embodiments, a linker that includes a functional group that allows for bridging of two interchain cysteines on the antibody binding construct may be used, such as a ThioBridge™ linker (Badescu et al., (2014) Bioconjug. Chem. 25:1124-1136), a dithiomaleimide (DTM) linker (Behrens et al., 2015, Mol. Pharm. 12:3986-3998), a dithioaryl(TCEP)pyridazinedione based linker (Lee et al., (2016) Chem. Sci. 7:799-802) or a dibromopyridazinedione based linker (Maruani et al., (2015) Nat. Commun. 6:6645).

A variety of linkers for linking drugs to antibodies and other antigen binding constructs are known in the art, including hydrazone-, disulfide- and peptide-based linkers.

Suitable linkers typically are more chemically stable to conditions outside the cell than to conditions inside the cell, although less stable linkers may be contemplated in certain situations, such as when the drug is selective or targeted and has a low toxicity to normal cells. Suitable linkers include, for example, cleavable and non-cleavable linkers. A cleavable linker is typically susceptible to cleavage under intracellular conditions, for example, through lysosomal processes. Examples include linkers that are protease-sensitive, acid-sensitive or reduction-sensitive. Non-cleavable linkers by contrast, rely on the degradation of the antibody in the cell, which typically results in the release of an amino acid-linker-cytotoxin moiety.

Suitable cleavable linkers include, for example, peptide-containing linkers cleavable by an intracellular protease, such as lysosomal protease or an endosomal protease. In exemplary embodiments, the linker can be a dipeptide-containing linker, such as a valine-citrulline (Val-Cit) or a phenylalanine-lysine (Phe-Lys) linker. Other examples of suitable dipeptides for inclusion in the linkers include Val-Lys, Ala-Lys, Phe-Lys, Val-Cit, Phe-Cit, Leu-Cit, Ile-Cit, Trp-Cit, Phe-Arg, Ala-Phe, Val-Ala, Met-Lys, Asn-Lys, Ile-Pro, Ile-Val, Asp-Val, His-Val, Met-(D)Lys, Asn-(D)Lys, Val-(D)Asp, NorVal-(D)Asp, Ala-(D)Asp, Me3Lys-Pro, PhenylGly-(D)Lys, Met-(D)Lys, Asn-(D)Lys, Pro-(D)Lys and Met-(D)Lys. Linkers may also include longer peptide sequences in some embodiments, such as the tripeptides Met-Cit-Val, Gly-Cit-Val, (D)Phe-Phe-Lys or (D)Ala-Phe-Lys, or the tetrapeptides Gly-Phe-Leu-Gly (SEQ ID NO: 1107) or Ala-Leu-Ala-Leu (SEQ ID NO: 1108).

Additional suitable cleavable linkers include disulfide-containing linkers. Examples of disulfide-containing linkers include, but are not limited to, N-succinimydyl-4-(2-pyridyldithio) butanoate (SPBD) and N-succinimydyl-4-(2-pyridyldithio)-2-sulfo butanoate (sulfo-SPBD). Disulfide-containing linkers may optionally include additional groups to provide steric hindrance adjacent to the disulfide bond in order to improve the extracellular stability of the linker, for example, inclusion of a geminal dimethyl group. Other suitable linkers include linkers hydrolyzable at a specific pH or within a pH range, such as hydrazone linkers. Linkers comprising combinations of these functionalities may also be useful, for example, linkers comprising both a hydrazone and a disulfide are known in the art.

A further example of a cleavable linker is a linker comprising a β-glucuronide, which is cleavable by β-glucuronidase, an enzyme present in lysosomes and tumor interstitium (see, for example, De Graaf et al., (2002) Curr. Pharm. Des. 8:1391-1403).

Cleavable linkers may optionally further comprise one or more additional functionalities such as self-immolative and self-elimination groups, stretchers or hydrophilic moieties.

Self-immolative and self-elimination groups that find use in linkers include, for example, p-aminobenzyloxycarbonyl (PABC) and p-aminobenzyl ether (PABE) groups, and methylated ethylene diamine (MED). Other examples of self-immolative groups include, but are not limited to, aromatic compounds that are electronically similar to the PABC or PABE group such as heterocyclic derivatives, for example 2-aminoimidazol-5-methanol derivatives as described in U.S. Pat. No. 7,375,078. Other examples include groups that undergo cyclization upon amide bond hydrolysis, such as substituted and unsubstituted 4-aminobutyric acid amides (Rodrigues et al. (1995) Chemistry Biology 2:223-227) and 2-aminophenylpropionic acid amides (Amsberry, et al. (1990) J. Org. Chem. 55:5867-5877). Self-immolative/self-elimination groups, alone or in combination are often included in peptide-based linkers, but may also be included in other types of linkers. In some embodiments, the linker may include one or more self-immolative and self-elimination groups, for example, a PABC group, a PABE group, or a combination of a PABC or PABE group and an MED.

Stretchers that find use in linkers for ADCs include, for example, alkylene groups and stretchers based on aliphatic acids, diacids, amines or diamines, such as diglycolate, malonate, caproate and caproamide. Other stretchers include, for example, glycine based stretchers and polyethylene glycol (PEG) or monomethoxy polyethylene glycol (mPEG) stretchers. PEG and mPEG stretchers also function as hydrophilic moieties and may be particularly useful with hydrophobic drugs, although their use in linkers with other drugs is also contemplated in some embodiments.

In certain embodiments, the linker included in the ADCs of the present disclosure are peptide-based linkers of general formula (VI):

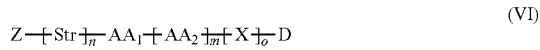

(VI)

wherein:
Z is a functional group capable of reacting with the target group on the antigen binding construct;
Str is a stretcher;
AA$_1$ and AA$_2$ are each independently an amino acid, wherein AA$_1$-[AA$_2$]$_m$ forms a protease cleavage site;
X is a self-immolative group;
D is a drug;
n is 0 or 1;
m is 1, 2 or 3, and
o is 0, 1 or 2.

In some embodiments, in general formula (VI):
Z is

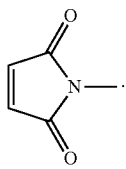

In some embodiments, in general formula (VI):
Str is

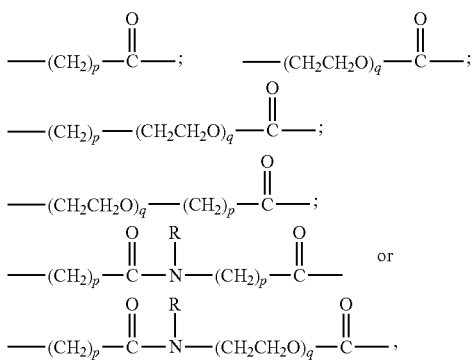

wherein
R is H or C$_1$-C$_6$ alkyl;
p is an integer between 2 and 10, and
q is an integer between 1 and 10.

In some embodiments, in general formula (VI):
Str is

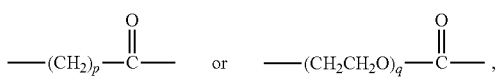

wherein p and q are as defined above.

In some embodiments, in general formula (VI):
Str is

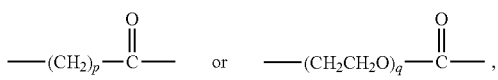

wherein p is an integer between 2 and 6, and
q is an integer between 2 and 8.

In some embodiments, in general formula (VI):
AA$_1$-[AA$_2$]$_m$ is selected from Val-Lys, Ala-Lys, Phe-Lys, Val-Cit, Phe-Cit, Leu-Cit, Ile-Cit, Trp-Cit, Phe-Arg, Ala-Phe, Val-Ala, Met-Lys, Asn-Lys, Ile-Pro, Ile-Val, Asp-Val, His-Val, Met-(D)Lys, Asn-(D)Lys, Val-(D)Asp, NorVal-(D)Asp, Ala-(D)Asp, Me$_3$Lys-Pro, PhenylGly-(D)Lys, Met-(D)Lys, Asn-(D)Lys, Pro-(D)Lys, Met-(D)Lys, Met-Cit-Val, Gly-Cit-Val, (D)Phe-Phe-Lys, (D)Ala-Phe-Lys, Gly-Phe-Leu-Gly (SEQ ID NO: 1107) and Ala-Leu-Ala-Leu (SEQ ID NO: 1108).

In some embodiments, in general formula (VI):
m is 1 (i.e. AA1-[AA2]m is a dipeptide).

In some embodiments, in general formula (VI):
AA$_1$-[AA$_2$]$_m$ is a dipeptide selected from Val-Lys, Ala-Lys, Phe-Lys, Val-Cit, Phe-Cit, Leu-Cit, Ile-Cit and Trp-Cit.

In some embodiments, in general formula (VI):
each X is independently selected from p-aminobenzyloxycarbonyl (PABC), p-aminobenzyl ether (PABE) and methylated ethylene diamine (MED).

In some embodiments, in general formula (VI):
n is 1.

In some embodiments, in general formula (VI):
o is 1 or 2.

In some embodiments, in general formula (VI):
Z is

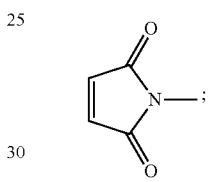

Str is

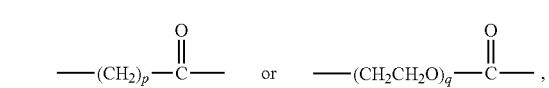

wherein p is an integer between 2 and 6, and q is an integer between 2 and 8;
m is 1 and AA$_1$-[AA$_2$]$_m$ is a dipeptide selected from Val-Lys, Ala-Lys, Phe-Lys, Val-Cit, Phe-Cit, Leu-Cit, Ile-Cit and Trp-Cit;
each X is independently selected from p-aminobenzyloxycarbonyl (PABC), p-aminobenzyl ether (PABE) and methylated ethylene diamine (MED).
n is 1, and
o is 1 or 2.

In some embodiments, the linker is a disulfide-containing linker and the ADC has general formula (VII):

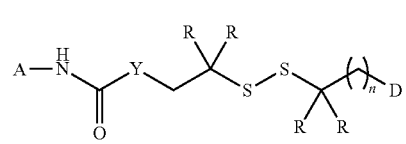

(VII)

wherein:
A is the antigen binding construct;
D is the drug;
Y is —(CH$_2$)$_p$— or —(CH$_2$CH$_2$O)$_q$—, wherein p and q are each independently an integer between 1 and 10;
each R is independently H or C$_1$-C$_6$ alkyl;
n is 1, 2 or 3, and wherein

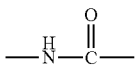

represents an amide bond formed between the linker and the ε-amino group of a surface lysine on the antigen binding construct.

In some embodiments in general formula (VII):
p and q are each independently an integer between 1 and 4.

In some embodiments in general formula (VII):
Y is —$(CH_2)_p$— and p is an integer between 1 and 4.

In some embodiments in general formula (VII):
each R is independently H or Me.

In some embodiments in general formula (VII):
n is 1 or 2.

In some embodiments in general formula (VII):
Y is —$(CH_2)_p$— and p is an integer between 1 and 4;
each R is independently H or Me, and
n is 1 or 2.

Examples of commonly used cleavable linkers that may find use in the ADCs of the present disclosure in some embodiments include, but are not limited to, linkers comprising SPBD, sulfo-SPBD, hydrazone, Val-Cit, maleidocaproyl (MC or mc), mc-Val-Cit, mc-Val-Cit-PABC, Phe-Lys, mc-Phe-Lys or mc-Phe-Lys-PABC.

Various non-cleavable linkers are known in the art for linking drugs to targeting moieties and may be useful in the ADCs of the present disclosure. Examples of non-cleavable linkers include linkers having an N-succinimidyl ester or N-sulfosuccinimidyl ester moiety for reaction with the cell binding agent, as well as a maleimido- or haloacetyl-based moiety for reaction with the drug, or vice versa. An example of such a non-cleavable linker is based on sulfosuccinimidyl-4-[N-maleimidomethyl]cyclohexane-1-carboxylate (sulfo-SMCC). Sulfo-SMCC conjugation typically occurs via a maleimide group which reacts with sulfhydryls (thiols, —SH) on the drug moiety, while the sulfo-NHS ester is reactive toward primary amines (as found in lysine and the protein or peptide N-terminus). Other non-limiting examples of such linkers include those based on N-succinimidyl 4-(maleimidomethyl)cyclohexanecarboxylate (SMCC), N-succinimidyl-4-(N-maleimidomethyl)-cyclohexane-1-carboxy-(6-amidocaproate) ("long chain" SMCC or LC-SMCC), κ-maleimidoundecanoic acid N-succinimidyl ester (KMUA), γ-maleimidobutyric acid N-succinimidyl ester (GMBS), ε-maleimidocaproic acid N-hydroxysuccinimide ester (EMCS), m-maleimidobenzoyl-N-hydroxysuccinimide ester (MBS), N-(α-maleimidoacetoxy)-succinimide ester (AMAS), succinimidyl-6-(β-maleimidopropionamido) hexanoate (SMPH), N-succinimidyl 4-(p-maleimidophenyl)-butyrate (SMPB), and N-(p-maleimidophenyl)isocyanate (PMPI). Other examples include those comprising a haloacetyl-based functional group such as N-succinimidyl-4-(iodoacetyl)-aminobenzoate (STAB), N-succinimidyl iodoacetate (SIA), N-succinimidyl bromoacetate (SBA) and N-succinimidyl 3-(bromoacetamido)propionate (SBAP).

Other examples of non-cleavable linkers include maleimidocarboxylic acids, such as maleimidocaproyl (MC).

In certain embodiments, the antigen binding construct is conjugated to the drug via a sulphonamide-containing linker as described in International Patent Publication No. WO 2015/095953. In some embodiments, the antigen binding construct is conjugated to the drug via a linker having general formula (VIII):

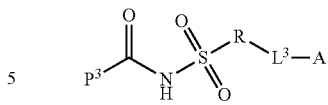

(VIII)

wherein:
R is selected from optionally substituted alkyl, optionally substituted alkylamino, optionally substituted cycloalkyl, optionally substituted aryl, optionally substituted heterocyclyl, optionally substituted heteroaryl, —$COR^{27}$—, —$CSR^{27}$—, —$OR^{27}$— and —$NHR^{27}$—, wherein each $R^{27}$ is independently selected from optionally substituted alkyl, optionally substituted alkylamino, optionally substituted cycloalkyl, optionally substituted aryl, optionally substituted heterocyclyl and optionally substituted heteroaryl;
$P^3$ is the drug or a portion of the drug;
$L^3$ is a linker or a portion of a linker, and
A is the antigen binding construct.

In some embodiments, the antigen binding construct is conjugated to the drug via a linker having general formula (IX):

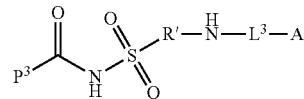

(IX)

wherein -$L^3$-A has the structure:

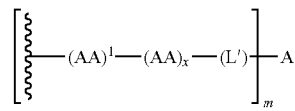

wherein:
$P^3$ is a remaining portion of the drug;
the —NH— group bonded to R' forms a peptide bond (the junction peptide bond or JPB) with $(AA)^1$;
R' is selected from optionally substituted alkyl, optionally substituted alkylamino, optionally substituted cycloalkyl, optionally substituted aryl, optionally substituted heterocyclyl, optionally substituted heteroaryl, —$COR^{27}$—, —$CSR^{27}$—, —$OR^{27}$— and —$NHR^{27}$—, wherein each $R^{27}$ is independently selected from optionally substituted alkyl, optionally substituted alkylamino, optionally substituted cycloalkyl, optionally substituted aryl, optionally substituted heterocyclyl and optionally substituted heteroaryl;
each AA is independently an amino acid, wherein $(AA)^1$-$(AA)_x$ taken together comprise an amino acid sequence capable of facilitating cleavage of the JPB;
x is an integer from 0 to 25;
L' is a remaining portion of the linker or is absent;
A is the antigen binding construct.

In some embodiments, the antigen-binding construct is coupled to the drug via a cleavable linker e.g. a SPBD linker or a maleimidocaproyl-valine-citrulline-p-aminobenzyloxycarbonyl (mc-Val-Cit-PABC) linker. In some embodiments, the antigen-binding construct is coupled to the drug via a non-cleavable linker e.g. a MCC linker formed using SMCC or sulfo-SMCC.

Selection of an appropriate linker for a given ADC may be readily made by the skilled person having knowledge of the art and taking into account relevant factors, such as the site of attachment to the antigen binding construct, any structural constraints of the drug and the hydrophobicity of the drug (see, for example, review in Nolting, Chapter 5, *Antibody-Drug Conjugates: Methods in Molecular Biology*, 2013, Ducry (Ed.), Springer). A number of specific linker-toxin combinations have been described and may be used with the antigen binding constructs described herein to prepare ADCs in certain embodiments. Examples include, but are not limited to, cleavable peptide-based linkers with auristatins such as MMAE and MMAF, camptothecins such as SN-38, duocarmycins and PBD dimers; non-cleavable MC-based linkers with auristatins MMAF and MMAE; acid-labile hydrazone-based linkers with calicheamicins and doxorubicin; disulfide-based linkers with maytansinoids such as DM1 and DM4, and bis-maleimido-trioxyethylene glycol (BMPEO)-based linkers with maytansinoid DM1 (see, for example, Peters & Brown, (2015) *Biosci. Rep.* e00225; Dosio et al., (2014) *Recent Patents on Anti-Cancer Drug Discovery* 9:35-65; US Patent Publication No. US 2015/0374847).

Preparation of ADCs

The ADC may be prepared by one of several routes known in the art, employing organic chemistry reactions, conditions, and reagents known to those skilled in the art (see, for example, *Bioconjugate Techniques* (G. T. Hermanson, 2013, Academic Press). For example, conjugation may be achieved by (1) reaction of a nucleophilic group or an electrophilic group of an antibody with a bivalent linker reagent, to form antibody-linker intermediate Ab-L, via a covalent bond, followed by reaction with an activated drug moiety D; or (2) reaction of a nucleophilic group or an electrophilic group of a drug moiety with a linker reagent, to form drug-linker intermediate D-L, via a covalent bond, followed by reaction with the nucleophilic group or an electrophilic group of an antibody. Conjugation methods (1) and (2) may be employed with a variety of antibodies, drug moieties, and linkers to prepare the ADCs described here. Various prepared linkers, linker components and toxins are commercially available or may be prepared using standard synthetic organic chemistry techniques (see, for example, March's Advanced Organic Chemistry (Smith & March, 2006, Sixth Ed., Wiley); Toki et al., (2002) *J. Org. Chem.* 67:1866-1872; Frisch et al., (1997) *Bioconj. Chem.* 7:180-186; *Bioconjugate Techniques* (G. T. Hermanson, 2013, Academic Press)). In addition, a number of pre-formed drug-linkers suitable for reaction with a selected antigen binding construct are also available commercially, for example, linker-toxins comprising DM1, DM4, MMAE, MMAF or Duocarmycin SA are available from Creative BioLabs (Shirley, N.Y.).

Several specific examples of methods of preparing ADCs are known in the art and are described in U.S. Pat. No. 8,624,003 (pot method), U.S. Pat. No. 8,163,888 (one-step), and U.S. Pat. No. 5,208,020 (two-step method). Other methods are known in the art and include those described in *Antibody-Drug Conjugates: Methods in Molecular Biology*, 2013, Ducry (Ed.), Springer. In addition, various antibody drug conjugation services are available commercially from companies such as Lonza Inc. (Allendale, N.J.), Abzena PLC (Cambridge, UK), ADC Biotechnology (St. Asaph, UK), Baxter BioPharma Solutions (Baxter Healthcare Corporation, Deerfield, Ill.) and Piramel Pharma Solutions (Grangemouth, UK).

The average number of drugs conjugated to the antigen binding construct (drug-to-antibody ratio or DAR) may be determined by standard techniques such as UV/VIS spectroscopic analysis, ELISA-based techniques, chromatography techniques such as hydrophobic interaction chromatography (HIC), UV-MALDI mass spectrometry (MS) and MALDI-TOF MS. In addition, distribution of drug-linked forms (for example, the fraction of antigen binding constructs containing zero, one, two, three, etc. drugs) may also optionally be analyzed. Various techniques are known in the art to measure such distribution, including MS (with or without an accompanying chromatographic separation step), hydrophobic interaction chromatography, reverse-phase HPLC or iso-electric focusing gel electrophoresis (IEF) (see, for example, Wakankar et al., (2011) *mAbs* 3:161-172).

Pharmaceutical Compositions

Also provided herein are pharmaceutical compositions comprising a drug-conjugated antigen-binding construct described herein. Pharmaceutical compositions comprise the construct and a pharmaceutically acceptable carrier.

The term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. In some aspects, the carrier is a man-made carrier not found in nature. Water can be used as a carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. Such compositions will contain a therapeutically effective amount of the compound, preferably in purified form, together with a suitable amount of carrier so as to provide the form for proper administration to the patient. The formulation should suit the mode of administration.

In certain embodiments, the composition comprising the construct is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anaesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

In certain embodiments, the compositions described herein are formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxide isopropylamine, triethylamine, 2-ethylamino ethanol, histidine, procaine, etc.

Methods of Treatment

Also described herein are methods of treating a disease or disorder comprising administering to a subject in which such treatment, prevention or amelioration is desired, an antigen-binding construct described herein, in an amount effective to treat, prevent or ameliorate the disease or disorder.

Disorder and disease are used interchangeably and refer to any condition that would benefit from treatment with an antigen-binding construct or method described herein. This includes chronic and acute disorders or diseases including those pathological conditions which predispose the mammal to the disorder in question. In some embodiments, the disorder is cancer.

The term "subject" refers to an animal which is the object of treatment, observation or experiment. An animal may be a human, a non-human primate, a companion animal (e.g., dogs, cats, and the like), farm animal (e.g., cows, sheep, pigs, horses, and the like) or a laboratory animal (e.g., rats, mice, guinea pigs, and the like).

The term "mammal" as used herein includes but is not limited to humans, non-human primates, canines, felines, murines, bovines, equines, and porcines.

"Treatment" refers to clinical intervention in an attempt to alter the natural course of the individual or cell being treated, and can be performed either for prophylaxis or during the course of clinical pathology. Desirable effects of treatment include preventing occurrence or recurrence of disease, alleviation of symptoms, diminishing of any direct or indirect pathological consequences of the disease, preventing metastasis, decreasing the rate of disease progression, amelioration or palliation of the disease state, and remission or improved prognosis. In some embodiments, antigen-binding constructs described herein are used to delay development of a disease or disorder. In one embodiment, antigen-binding constructs and methods described herein effect tumor regression. In one embodiment, antigen-binding constructs and methods described herein effect inhibition of tumor/cancer growth.

Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, construct constructs described herein are used to delay development of a disease or disorder or to slow the progression of a disease.

The term "effective amount" as used herein refers to that amount of construct being administered, which will accomplish the goal of the recited method, e.g., relieve to some extent one or more of the symptoms of the disease, condition or disorder being treated. The amount of the composition described herein which will be effective in the treatment, inhibition and prevention of a disease or disorder associated with aberrant expression and/or activity of a therapeutic protein can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses are extrapolated from dose-response curves derived from in vitro or animal model test systems.

Therapeutic Uses:

In an aspect, the antigen-binding constructs and drug-conjugated antigen-binding constructs described herein are used in antibody-based therapies which involve administering the antigen-binding constructs, or nucleic acids encoding antigen-binding constructs to a patient for treating one or more diseases, disorders, or conditions. Such disorders, diseases and conditions may include, but are not limited to, cancer (hematological, solid tumor or metastatic), autoimmune diseases, inflammatory diseases, and diseases caused by pathogen such as viruses, bacteria, parasites or fungi that express antigens on the cell surface of an infected host. Targets useful in these constructs are found in Table LL.

In some embodiments, the drug-conjugated antigen-binding constructs do not substantially deplete the T cells of a subject to which the construct is administered. As used herein "substantially deplete" T cells means reduce the number of T cells to a number that is less than about 75%, less than about 50%, or less than about 25 percent of the pre-administration number.

In certain embodiments is provided a method for the prevention, treatment or amelioration of cancer, said method comprising administering to a subject in need of such prevention, treatment or amelioration a pharmaceutical composition comprising an antigen-binding construct described herein.

In certain embodiments is a method of treating cancer in a mammal in need thereof, comprising administering to the mammal a composition comprising an effective amount of the pharmaceutical composition described herein, optionally in combination with other pharmaceutically active molecules. In certain embodiments, the cancer is a lymphoma or leukemia.

In some embodiments, the cancer is a lymphoma or leukemia or a B cell malignancy, or a cancer that expresses CD19, or non-Hodgkin's lymphoma (NHL) or mantle cell lymphoma (MCL) or acute lymphoblastic leukemia (ALL) or chronic lymphocytic leukemia (CLL) or rituximab- or CHOP (Cytoxan™/Adriamycin™ vincristine/prednisone therapy)-resistant B cell cancer, or a blinatumomab-resistant or refractory B cell cancer. In some embodiments, the cancer is a solid tumor. In some embodiments, the cancer is a non-inflammatory tumor that is not easily infiltrated with lymphocytes.

In a further aspect, the antigen-binding constructs and drug-conjugated antigen-binding constructs described herein are for use in the manufacture or preparation of a medicament. In one embodiment, the medicament is for treatment of cancer. In certain embodiments, the medicament is for the treatment of lymphoma or leukemia. In other embodiments, the medicament is for the treatment of cancer described above. In another embodiment, the medicament is for use in a method of treating cancer comprising administering to patient having cancer, an effective amount of the medicament.

In certain embodiments, the methods and uses described herein further comprise administering to the patient an effective amount of at least one additional therapeutic agent, e.g., cytotoxic agents, chemotherapeutic agents, cytokines, growth inhibitory agents, kinase inhibitors, anti-angiogenic agents, cardioprotectants, immunostimulatory agents, immunosuppressive agents, protein tyrosine kinase (PTK) inhibitors, other antibodies, Fc fusions, or immunoglobulins, or other therapeutic agents.

In certain embodiments, the additional therapeutic agent is for preventing and/or treating cancer. Such combination therapy encompasses combined administration (where two or more therapeutic agents are included in the same or separate formulations), and separate administration, in which case, administration of the antigen-binding construct described herein can occur prior to, simultaneously, and/or following, administration of the additional therapeutic agent and/or adjuvant.

The antigen-binding constructs and drug-conjugated antigen-binding constructs described herein may be administered alone or in combination with other types of treatments (e.g., radiation therapy, chemotherapy, hormonal therapy, immunotherapy and anti-tumor agents).

Demonstration of Therapeutic or Prophylactic Activity:

The drug-conjugated antigen-binding constructs or pharmaceutical compositions described herein are tested in vitro, and then in vivo for the desired therapeutic or prophylactic activity, prior to use in humans. For example, in vitro assays to demonstrate the therapeutic or prophylactic utility of a compound or pharmaceutical composition include, the effect of a compound on a cell line or a patient tissue sample. The effect of the compound or composition on the cell line and/or tissue sample can be determined utilizing techniques known to those of skill in the art including, but not limited to, rosette formation assays and cell lysis assays.

Therapeutic/Prophylactic Administration and Composition:

Provided are methods of treatment, inhibition and prophylaxis by administration to a subject of an effective amount of an antigen-binding construct or pharmaceutical composition described herein. In an embodiment, the antigen-binding construct is substantially purified (e.g., substantially free from substances that limit its effect or produce undesired side-effects). In certain embodiments, the subject is an animal, including but not limited to animals such as cows, pigs, horses, chickens, cats, dogs, etc., and in certain embodiments, a mammal, and most preferably human.

Various delivery systems are known and can be used to administer an antigen-binding construct formulation described herein, e.g., encapsulation in liposomes, microparticles, microcapsules, recombinant cells capable of expressing the antigen-binding constructs, receptor-mediated endocytosis (see, e.g., Wu and Wu, J. Biol. Chem. 262:4429-4432 (1987)), construction of a nucleic acid as part of a retroviral or other vector, etc. Methods of introduction include but are not limited to intradermal, intramuscular, intraperitoneal, intravenous, subcutaneous, intranasal, epidural, and oral routes. The antigen-binding constructs may be administered by any convenient route, for example by infusion or bolus injection, by absorption through epithelial or mucocutaneous linings (e.g., oral mucosa, rectal and intestinal mucosa, etc.) and may be administered together with other therapeutic agents. Administration can be systemic or local. Suitable routes of administration include intraventricular and intrathecal injection; intraventricular injection may be facilitated by an intraventricular catheter, for example, attached to a reservoir, such as an Ommaya reservoir. Pulmonary administration can also be employed, e.g., by use of an inhaler or nebulizer, and formulation with an aerosolizing agent.

In a specific embodiment, it is desirable to administer the antigen-binding constructs, or compositions described herein locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non-porous, or gelatinous material, including membranes, such as sialastic membranes, or fibers. Preferably, when administering a protein, including an antibody, of the invention, care must be taken to use materials to which the protein does not absorb.

In another embodiment, the antigen-binding constructs or composition can be delivered in a vesicle, in particular a liposome (see Langer, Science 249:1527-1533 (1990); Treat et al., in Liposomes in the Therapy of Infectious Disease and Cancer, Lopez-Berestein and Fidler (eds.), Liss, New York, pp. 353-365 (1989); Lopez-Berestein, ibid., pp. 317-327; see generally ibid.)

In yet another embodiment, the antigen-binding constructs or composition can be delivered in a controlled release system. In one embodiment, a pump may be used (see Langer, supra; Sefton, CRC Crit. Ref. Biomed. Eng. 14:201 (1987); Buchwald et al., Surgery 88:507 (1980); Saudek et al., N. Engl. J. Med. 321:574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J., Macromol. Sci. Rev. Macromol. Chem. 23:61 (1983); see also Levy et al., Science 228:190 (1985); During et al., Ann. Neurol. 25:351 (1989); Howard et al., J. Neurosurg. 71:105 (1989)). In yet another embodiment, a controlled release system can be placed in proximity of the therapeutic target, e.g., the brain, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

Kits and Articles of Manufacture

Also described herein are kits comprising one or more antigen-binding constructs described herein. Individual components of the kit would be packaged in separate containers and, associated with such containers, can be a notice in the form prescribed by a governmental agency regulating the manufacture, use or sale of pharmaceuticals or biological products, which notice reflects approval by the agency of manufacture, use or sale. The kit may optionally contain instructions or directions outlining the method of use or administration regimen for the antigen-binding construct, sometimes referred to as a "package insert".

When one or more components of the kit are provided as solutions, for example an aqueous solution, or a sterile aqueous solution, the container means may itself be an inhalant, syringe, pipette, eye dropper, or other such like apparatus, from which the solution may be administered to a subject or applied to and mixed with the other components of the kit.

The components of the kit may also be provided in dried or lyophilized form and the kit can additionally contain a suitable solvent for reconstitution of the lyophilized components. Irrespective of the number or type of containers, the kits described herein also may comprise an instrument for assisting with the administration of the composition to a patient. Such an instrument may be an inhalant, nasal spray device, syringe, pipette, forceps, measured spoon, eye dropper or similar medically approved delivery vehicle.

In another aspect described herein, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). At least one active agent in the composition is a T cell activating antigen-binding construct described herein. The label or package insert indicates that the composition is used for treating the condition of choice. Moreover, the article of manufacture may comprise (a) a first container with a composition contained therein, wherein the composition comprises an antigen-binding construct described herein; and (b) a second container with a composition contained therein, wherein the composition comprises a further cytotoxic or otherwise therapeutic agent. The article of manufacture in this embodiment described herein may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

Polypeptides and Polynucleotides

The antigen-binding constructs described herein comprise at least one polypeptide. Also described are polynucleotides encoding the polypeptides described herein. The polypeptides and polynucleotides are typically isolated.

As used herein, "isolated" means an agent (e.g., a polypeptide or polynucleotide) that has been identified and separated and/or recovered from a component of its natural cell culture environment. Contaminant components of its natural environment are materials that would interfere with diagnostic or therapeutic uses for the antigen-binding construct, and may include enzymes, hormones, and other proteinaceous or non-proteinaceous solutes. Isolated also refers to an agent that has been synthetically produced, e.g., via human intervention.

The terms "polypeptide," "peptide" and "protein" are used interchangeably herein to refer to a polymer of amino acid residues. That is, a description directed to a polypeptide applies equally to a description of a peptide and a description of a protein, and vice versa. The terms apply to naturally occurring amino acid polymers as well as amino acid polymers in which one or more amino acid residues is a non-naturally encoded amino acid. As used herein, the terms encompass amino acid chains of any length, including full length proteins, wherein the amino acid residues are linked by covalent peptide bonds.

The term "amino acid" refers to naturally occurring and non-naturally occurring amino acids, as well as amino acid analogs and amino acid mimetics that function in a manner similar to the naturally occurring amino acids. Naturally encoded amino acids are the 20 common amino acids (alanine, arginine, asparagine, aspartic acid, cysteine, glutamine, glutamic acid, glycine, histidine, isoleucine, leucine, lysine, methionine, phenylalanine, praline, serine, threonine, tryptophan, tyrosine, and valine) and pyrrolysine and selenocysteine. Amino acid analogs refers to compounds that have the same basic chemical structure as a naturally occurring amino acid, i.e., an α carbon that is bound to a hydrogen, a carboxyl group, an amino group, and an R group, such as, homoserine, norleucine, methionine sulfoxide, methionine methyl sulfonium. Such analogs have modified R groups (such as, norleucine) or modified peptide backbones, but retain the same basic chemical structure as a naturally occurring amino acid. Reference to an amino acid includes, for example, naturally occurring proteogenic L-amino acids; D-amino acids, chemically modified amino acids such as amino acid variants and derivatives; naturally occurring non-proteogenic amino acids such as β-alanine, ornithine, etc.; and chemically synthesized compounds having properties known in the art to be characteristic of amino acids. Examples of non-naturally occurring amino acids include, but are not limited to, α-methyl amino acids (e.g. α-methyl alanine), D-amino acids, histidine-like amino acids (e.g., 2-amino-histidine, β-hydroxy-histidine, homohistidine), amino acids having an extra methylene in the side chain ("homo" amino acids), and amino acids in which a carboxylic acid functional group in the side chain is replaced with a sulfonic acid group (e.g., cysteic acid). The incorporation of non-natural amino acids, including synthetic non-native amino acids, substituted amino acids, or one or more D-amino acids into the proteins of the present invention may be advantageous in a number of different ways. D-amino acid-containing peptides, etc., exhibit increased stability in vitro or in vivo compared to L-amino acid-containing counterparts. Thus, the construction of peptides, etc., incorporating D-amino acids can be particularly useful when greater intracellular stability is desired or required. More specifically, D-peptides, etc., are resistant to endogenous peptidases and proteases, thereby providing improved bioavailability of the molecule, and prolonged lifetimes in vivo when such properties are desirable. Additionally, D-peptides, etc., cannot be processed efficiently for major histocompatibility complex class II-restricted presentation to T helper cells, and are therefore, less likely to induce humoral immune responses in the whole organism.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

Also described herein are polynucleotides encoding polypeptides of the antigen-binding constructs. The term "polynucleotide" or "nucleotide sequence" is intended to indicate a consecutive stretch of two or more nucleotide molecules. The nucleotide sequence may be of genomic, cDNA, RNA, semisynthetic or synthetic origin, or any combination thereof.

The term "nucleic acid" refers to deoxyribonucleotides, deoxyribonucleosides, ribonucleosides, or ribonucleotides and polymers thereof in either single- or double-stranded form. Unless specifically limited, the term encompasses nucleic acids containing known analogues of natural nucleotides which have similar binding properties as the reference nucleic acid and are metabolized in a manner similar to naturally occurring nucleotides. Unless specifically limited otherwise, the term also refers to oligonucleotide analogs including PNA (peptidonucleic acid), analogs of DNA used in antisense technology (phosphorothioates, phosphoroamidates, and the like). Unless otherwise indicated, a particular nucleic acid sequence also implicitly encompasses conservatively modified variants thereof (including but not limited to, degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); Rossolini et al., Mol. Cell. Probes 8:91-98 (1994)).

"Conservatively modified variants" applies to both amino acid and nucleic acid sequences. With respect to particular nucleic acid sequences, "conservatively modified variants" refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of ordinary skill in the art will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence.

As to amino acid sequences, one of ordinary skill in the art will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the deletion of an amino acid, addition of an amino acid, or substitution of an amino acid with a chemically similar amino acid. Conservative substitution tables providing functionally similar amino acids are known to those of ordinary skill in the art. Such conservatively modified variants are in addition to and do not exclude polymorphic variants, interspecies homologs, and alleles described herein.

Conservative substitution tables providing functionally similar amino acids are known to those of ordinary skill in the art. The following eight groups each contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and [0139] 8) Cysteine (C), Methionine (M) (see, e.g., Creighton, Proteins: Structures and Molecular Properties (W H Freeman & Co.; 2nd edition (December 1993)

The terms "identical" or percent "identity," in the context of two or more nucleic acids or polypeptide sequences, refer to two or more sequences or subsequences that are the same. Sequences are "substantially identical" if they have a percentage of amino acid residues or nucleotides that are the same (i.e., about 60% identity, about 65%, about 70%, about 75%, about 80%, about 85%, about 90%, or about 95% identity over a specified region), when compared and aligned for maximum correspondence over a comparison window, or designated region as measured using one of the following sequence comparison algorithms (or other algorithms available to persons of ordinary skill in the art) or by manual alignment and visual inspection. This definition also refers to the complement of a test sequence. The identity can exist over a region that is at least about 50 amino acids or nucleotides in length, or over a region that is 75-100 amino acids or nucleotides in length, or, where not specified, across the entire sequence of a polynucleotide or polypeptide. A polynucleotide encoding a polypeptide of the present invention, including homologs from species other than human, may be obtained by a process comprising the steps of screening a library under stringent hybridization conditions with a labeled probe having a polynucleotide sequence described herein or a fragment thereof, and isolating full-length cDNA and genomic clones containing said polynucleotide sequence. Such hybridization techniques are well known to the skilled artisan.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are known to those of ordinary skill in the art. Optimal alignment of sequences for comparison can be conducted, including but not limited to, by the local homology algorithm of Smith and Waterman (1970) Adv. Appl. Math. 2:482c, by the homology alignment algorithm of Needleman and Wunsch (1970) J. Mol. Biol. 48:443, by the search for similarity method of Pearson and Lipman (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Ausubel et al., Current Protocols in Molecular Biology (1995 supplement)).

One example of an algorithm that is suitable for determining percent sequence identity and sequence similarity are the BLAST and BLAST 2.0 algorithms, which are described in Altschul et al. (1997) Nuc. Acids Res. 25:3389-3402, and Altschul et al. (1990) J. Mol. Biol. 215:403-410, respectively. Software for performing BLAST analyses is publicly available through the National Center for Biotechnology Information available at the World Wide Web at ncbi.nlm.nih.gov. The BLAST algorithm parameters W, T, and X determine the sensitivity and speed of the alignment. The BLASTN program (for nucleotide sequences) uses as defaults a wordlength (W) of 11, an expectation (E) or 10, M=5, N=-4 and a comparison of both strands. For amino acid sequences, the BLASTP program uses as defaults a wordlength of 3, and expectation (E) of 10, and the BLOSUM62 scoring matrix (see Henikoff and Henikoff (1992) Proc. Natl. Acad. Sci. USA 89:10915) alignments (B) of 50, expectation (E) of 10, M=5, N=-4, and a comparison of both strands. The BLAST algorithm is typically performed with the "low complexity" filter turned off.

The BLAST algorithm also performs a statistical analysis of the similarity between two sequences (see, e.g., Karlin and Altschul (1993) Proc. Natl. Acad. Sci. USA 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, or less than about 0.01, or less than about 0.001.

The phrase "selectively (or specifically) hybridizes to" refers to the binding, duplexing, or hybridizing of a molecule only to a particular nucleotide sequence under stringent hybridization conditions when that sequence is present in a complex mixture (including but not limited to, total cellular or library DNA or RNA).

The phrase "stringent hybridization conditions" refers to hybridization of sequences of DNA, RNA, or other nucleic acids, or combinations thereof under conditions of low ionic strength and high temperature as is known in the art. Typically, under stringent conditions a probe will hybridize to its target subsequence in a complex mixture of nucleic acid (including but not limited to, total cellular or library DNA or RNA) but does not hybridize to other sequences in the complex mixture. Stringent conditions are sequence-dependent and will be different in different circumstances. Longer sequences hybridize specifically at higher temperatures. An extensive guide to the hybridization of nucleic acids is found in Tijssen, Laboratory Techniques in Biochemistry and Molecular Biology—Hybridization with Nucleic Probes, "Overview of principles of hybridization and the strategy of nucleic acid assays" (1993).

As used herein, the terms "engineer, engineered, engineering", are considered to include any manipulation of the peptide backbone or the post-translational modifications of a naturally occurring or recombinant polypeptide or fragment thereof. Engineering includes modifications of the amino acid sequence, of the glycosylation pattern, or of the side chain group of individual amino acids, as well as combinations of these approaches. The engineered proteins are expressed and produced by standard molecular biology techniques.

By "isolated nucleic acid molecule or polynucleotide" is intended a nucleic acid molecule, DNA or RNA, which has been removed from its native environment. For example, a recombinant polynucleotide encoding a polypeptide contained in a vector is considered isolated. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extrachromosomally or at a chromosomal location that is different from its natural chromosomal location. Isolated RNA molecules include in vivo or in vitro RNA transcripts, as well as positive and negative strand forms, and double-stranded forms. Isolated polynucleotides or nucleic acids described herein, further include such molecules produced synthetically, e.g., via PCR or chemical synthesis. In addition, a polynucleotide or a nucleic acid, in certain embodiments, include a regulatory element such as a promoter, ribosome binding site, or a transcription terminator.

The term "polymerase chain reaction" or "PCR" generally refers to a method for amplification of a desired nucleotide sequence in vitro, as described, for example, in U.S. Pat. No. 4,683,195. In general, the PCR method involves repeated cycles of primer extension synthesis, using oligonucleotide primers capable of hybridising preferentially to a template nucleic acid.

By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

A derivative, or a variant of a polypeptide is said to share "homology" or be "homologous" with the peptide if the amino acid sequences of the derivative or variant has at least 50% identity with a 100 amino acid sequence from the original peptide. In certain embodiments, the derivative or variant is at least 75% the same as that of either the peptide or a fragment of the peptide having the same number of amino acid residues as the derivative. In certain embodiments, the derivative or variant is at least 85% the same as that of either the peptide or a fragment of the peptide having the same number of amino acid residues as the derivative. In certain embodiments, the amino acid sequence of the derivative is at least 90% the same as the peptide or a fragment of the peptide having the same number of amino acid residues as the derivative. In some embodiments, the amino acid sequence of the derivative is at least 95% the same as the peptide or a fragment of the peptide having the same number of amino acid residues as the derivative. In certain embodiments, the derivative or variant is at least 99% the same as that of either the peptide or a fragment of the peptide having the same number of amino acid residues as the derivative.

The term "modified," as used herein refers to any changes made to a given polypeptide, such as changes to the length of the polypeptide, the amino acid sequence, chemical structure, co-translational modification, or post-translational modification of a polypeptide. The form "(modified)" term means that the polypeptides being discussed are optionally modified, that is, the polypeptides under discussion can be modified or unmodified.

In some aspects, an antigen-binding construct comprises an amino acids sequence that is at least 80, 85, 90, 91, 92, 93, 94, 95, 96, 97, 98, 99, or 100% identical to a relevant amino acid sequence or fragment thereof set forth in the Table(s) or accession number(s) disclosed herein. In some aspects, an isolated antigen-binding construct comprises an amino acids sequence encoded by a polynucleotide that is at least 80, 85, 90, 91, 92, 93, 94, 95, 96, 97, 98, 99, or 100% identical to a relevant nucleotide sequence or fragment thereof set forth in Table(s) or accession number(s) disclosed herein.

Unless defined otherwise, all technical and scientific terms used herein have the same meaning as is commonly understood by one of skill in the art to which the claimed subject matter belongs. In the event that there are a plurality of definitions for terms herein, those in this section prevail. Where reference is made to a URL or other such identifier or address, it is understood that such identifiers can change and particular information on the internet can come and go, but equivalent information can be found by searching the internet. Reference thereto evidences the availability and public dissemination of such information. Terms understood by those in the art of antibody technology are each given the meaning acquired in the art, unless expressly defined differently herein.

It is to be understood that the general description and following detailed description are exemplary and explanatory only and are not restrictive of any subject matter claimed.

In this application, the use of the singular includes the plural unless specifically stated otherwise.

In the present description, any concentration range, percentage range, ratio range, or integer range is to be understood to include the value of any integer within the recited range and, when appropriate, fractions thereof (such as one tenth and one hundredth of an integer), unless otherwise indicated. As used herein, "about" means±10% of the indicated range, value, sequence, or structure, unless otherwise indicated. It should be understood that the terms "a" and "an" as used herein refer to "one or more" of the enumerated components unless otherwise indicated or dictated by its context. The use of the alternative (e.g., "or") should be understood to mean either one, both, or any combination thereof of the alternatives. As used herein, the terms "include" and "comprise" are used synonymously. In addition, it should be understood that the individual single chain polypeptides or immunoglobulin constructs derived from various combinations of the structures and substituents described herein are disclosed by the present application to the same extent as if each single chain polypeptide or heterodimer were set forth individually. Thus, selection of particular components to form individual single chain polypeptides or heterodimers is within the scope of the present disclosure The section headings used herein are for organizational purposes only and are not to be construed as limiting the subject matter described.

It is to be understood that the methods and compositions described herein are not limited to the particular methodology, protocols, cell lines, constructs, and reagents described herein and as such may vary. It is also to be understood that the terminology used herein is for the purpose of describing particular embodiments only, and is not intended to limit the scope of the methods and compositions described herein, which will be limited only by the appended claims.

All documents, or portions of documents, cited in the application including, but not limited to, patents, patent applications, articles, books, manuals, and treatises are hereby expressly incorporated by reference in their entirety for any purpose. All publications and patents mentioned herein are incorporated herein by reference in their entirety for the purpose of describing and disclosing, for example, the constructs and methodologies that are described in the publications, which might be used in connection with the methods, compositions and compounds described herein. The publications discussed herein are provided solely for their disclosure prior to the filing date of the present application. Nothing herein is to be construed as an admission that the inventors described herein are not entitled to antedate such disclosure by virtue of prior invention or for any other reason.

EXAMPLES

The following specific and non-limiting examples are to be construed as merely illustrative, and do not limit the present disclosure in any way whatsoever. Without further elaboration, it is believed that one skilled in the art can, based on the description herein, utilize the present disclosure to its fullest extent. All publications cited herein are hereby incorporated by reference in their entirety. Where reference is made to a URL or other such identifier or address, it is understood that such identifiers can change and particular information on the internet can come and go, but equivalent information can be found by searching the internet. Reference thereto evidences the availability and public dissemination of such information.

Exemplary bi-specific anti-CD3-CD19, anti-CD3-CDH3, anti-CD3-1-fER2, anti-CD3-HER3 and anti-CD3-EGFR antigen-binding constructs were made as described below. An exemplary schematic representation of these type of constructs is shown in FIGS. 1A-D. All formats are based on the heterodimeric Fc constructed by known mutations in the $CH_3$ domain (Von Kreudenstein et al., MAbs. 2013 5(5): 646-54). Exemplary constructs were conjugated to drugs to make ADCs using exemplary drugs DM1, DM4 and MMAE.

Example 1. Description, Expression and Purification of Bi-Specific Anti-CD19-CD3 Antigen-Binding Constructs Useful for ADCs in Dual scFv Format Bispecific antibodies against CD3 and CD19 were designed, expressed and characterized as described in PCT/US2015/011664. Briefly, the genes encoding the antibody heavy and light chains were constructed via gene synthesis using codons optimized for human/mammalian expression. The scFv-Fc sequences were generated from a known anti-CD3 and CD19 scFv BiTE™ antibody (Kipriyanov et. al., 1998, Int. J Cancer: 77, 763-772), anti-CD3 monoclonal antibody OKT3 (Drug Bank reference: DB00075). The dual scFv variants made are described in Table 1.

TABLE 1

Dual scFv variants

| Variant | Chain A | Chain B | Fc |
|---|---|---|---|
| 873 | αCD19_HD37 scFv | αCD3 (blinatumomab) scFv | Het Fc 1 |
| 875 | αCD19_HD37 scFv | αCD3_OKT3 scFv | Het Fc 1 |
| 1661 | αCD19_HD37 scFv | αCD3_OKT3 scFv | Het Fc 2; FcγR KO 2 |
| 1653 | αCD19_HD37 scFv | αCD3_OKT3 scFv (CDR C->S) | Het Fc 2 |
| 1662 | αCD19_HD37 scFv | αCD3_OKT3 scFv (CDR C->S) | Het Fc 2; FcγR KO 2 |
| 1660 | αCD3_OKT3 scFv (VHVL linker) | αCD19_HD37 scFv | Het Fc 2 |
| 1666 | αCD3_OKT3 scFv (VHVL linker) | αCD19_HD37 scFv | Het Fc 2; FcγR KO 2 |
| 1801 | αCD19_HD37 scFv | αCD3_OKT3 scFv (VLVH SS) | Het Fc 2 |
| N1 | αCD19_HD37 scFv | αCD3_OKT3 scFv (VLVH SS) | Het Fc 2; FcγR KO 2 |
| 6747 | αCD19_HD37 scFv (VLVH SS) | αCD3_OKT3 scFv (VLVH SS) | Het Fc 2 |
| 10149 | αCD19_HD37 scFv (VLVH SS) | αCD3_OKT3 scFv (VLVH SS) | Het Fc 2; FcγR KO 2 |
| N3 | αCD19_HD37 scFv (VLVH SS) | αCD3_OKT3 scFv (CDR C->S) (VLVH SS) | Het Fc 2 |
| 10150 | αCD19_HD37 scFv (VLVH SS) | αCD3_OKT3 scFv (CDR C->S) (VLVH SS) | Het Fc 2; FcγR KO 2 |
| 1380 | αCD19_HD37 scFv | αCD3_BiTE scFv | Het Fc 2; FcγR KO 1 |
| N10 | αCD19_HD37 scFv, humanized (VLVH SS) | αCD3_OKT3 scFv (VLVH SS) | Het Fc 2 |

Het Fc 1=Chain A: L351Y_F405A_Y407V; Chain B: T366L_K392M_T394W (EU numbering system for IgG1 Fc)

Het Fc 2=Chain A: T350V_L351Y_F405A_Y407V; Chain B: T350V_T366L_K392L_T394W

FcγR KO 1=Chain A: L234A_L235A; Chain B: L234A_L235A

FcγR KO 2=Chain A: D265S_L234A_L235A; Chain B: D265S_L234A_L235A

αCD19_HD37 scFv—N- to C-terminal order of variable regions is VL/VH unless otherwise indicated αCD3_OKT3 scFv—N- to C-terminal order of variable regions is VL/VH unless otherwise indicated. The VLVH are connected by a (GGGGS)3 linker (SEQ ID NO: 1087).

αCD3_BiTE scFv—N- to C-terminal order of variable regions is VH/VL and linker and composition is identical to blinatumomab.

(VLVH SS) or (VHVL SS) indicates disulfide stabilized scFv utilizing the published positions VH 44 and VL 100, according to the Kabat numbering system, to introduce a disulphide link between the VH and VL of the scFv [Reiter et al., Nat. Biotechnol. 14:1239-1245 (1996)].

(CDR C->S)—indicates a mutation in the H3 CDR of OKT3 as referenced below (VHVL linker)—indicates VH and VL connected by the linker SSTGGGGSGGGGSGGGGSDI (SEQ ID NO: 1088).

Fc numbering is according to EU index as in Kabat referring to the numbering of the EU antibody (Edelman et al., 1969, Proc Natl Acad Sci USA 63:78-85); Fab or variable domain numbering is according to Kabat (Kabat and Wu, 1991; Kabat et al, Sequences of proteins of immunological interest. 5th Edition—US Department of Health and Human Services, NIH publication no. 91-3242, p 647 (1991)).

The variants described in Table 1 include variant 875, a preliminary design, which was used as a starting point to generate antigen-binding constructs with improved yield and biophysical properties. The modifications include stabilization of the scFv by VLVH disulfide engineering and/or adding stabilizing CDR mutations. All variants include a heterodimeric Fc (Het Fc 1 or Het Fc 2) and can be expressed with or without mutations in the $CH_2$ domain (FcγR KO 1 or FcγR KO 2) to abolish Fc effector activity. Variants including this modification to the Fc are referred to as having an Fc knockout or Fc KO.

Variants 875, 1661, 1653, 1662, 1660, 1666, 1801, and 1380 are initial designs of the CD3-CD19 antigen-binding constructs developed, while variants 6747, 10149, and 12043 exemplify designs that include modifications designed to further improve yield and biophysical properties of the CD3-CD19 antigen-binding constructs (see Example 3-4 for additional details). Variants N1, N3 and N10 have also been designed and the biophysical and functional characteristics of these variants can be predicted from the data provided herein.

The VHVL disulfide engineering strategy for both the CD3 and CD19 scFvs utilized the published positions VH 44 and VL 100, according to the Kabat numbering system, to introduce a disulphide link between the VH and VL of the scFv [Reiter et al., Nat. Biotechnol. 14:1239-1245 (1996)]. The mutation of C to S in the H3 CDR of αCD3 OKT3 scFv was generated as described in Kipryanov et al., in Protein Engineering 10: 445-453 (1997).

The final gene products were sub-cloned into the mammalian expression vector pTT5 (NRC-BRI, Canada) and expressed in CHO cells (Durocher, Y., Perret, S. & Kamen, A. High-level and high-throughput recombinant protein production by transient transfection of suspension-growing CHO cells. *Nucleic acids research* 30, E9 (2002)).

The CHO cells were transfected in exponential growth phase (1.5 to 2 million cells/mL) with aqueous 1 mg/mL 25 kDa polyethylenimine (PEI, Polysciences) at a EI:DNA ratio of 2.5:1. (Raymond C. et al. A simplified polyethylenimine-mediated transfection process for large-scale and high-throughput applications. Methods. 55(1):44-51 (2011)). In order to determine the optimal concentration range for forming heterodimers, the DNA was transfected in optimal DNA ratios of the heavy chain A (HC-A), and heavy chain B (HC-B) that allow for heterodimer formation (e.g. HC-A/HC-B/ratios=50:50%). Transfected cells were harvested after 5-6 days with the culture medium collected after centrifugation at 4000 rpm and clarified using a 0.45 μm filter.

The clarified culture medium was loaded onto a MabSelect SuRe (GE Healthcare) protein-A column and washed with 10 column volumes of PBS buffer at pH 7.2. The antibody was eluted with 10 column volumes of citrate buffer at pH 3.6 with the pooled fractions containing the antibody neutralized with TRIS at pH 11. The protein was desalted using an Econo-Pac 10DG column (Bio-Rad).

In some cases, the protein was further purified by gel filtration, 3.5 mg of the antibody mixture was concentrated to 1.5 mL and loaded onto a Superdex 200 HiLoad 16/600 200 pg column (GE Healthcare) via an AKTA Express FPLC at a flow-rate of 1 mL/min. PBS buffer at pH 7.4 was used at a flow-rate of 1 mL/min. Fractions corresponding to the purified antibody were collected, concentrated to ~1 mg/mL and stored at −80° C.

An additional purification step using, protein L chromatography after protein a purification could be carried out by the method as follows. Capto L resin was equilibrated with PBS and the variant was added to the resin and incubated at RT for 30 min. The resin was washed with PBS, and bound protein was eluted with 0.5 ml 0.1 M Glycine, pH 3.

The purity and yield of the final product was estimated by LC/MS and UPLC-SEC as described in detail in PCT/US2015/011664. All variants were expressed and purified to >95% heterodimer purity without contaminating homodimers.

The clones that correspond to each bi-specific anti-CD3-CD19 antigen-binding construct are shown in Table XX (at the end of the Examples), and the corresponding sequence composition of each clone is shown in Table YY. The CDR sequences used in the variants are shown in Table S1.

TABLE S1

CDR sequences CD3 and CD19 antigen binding constructs

| Antigen binding constructs CDR sequence | SEQ ID NO: |
|---|---|
| Wild-type OKT3 (CD3 binding) | |
| L1: SSVSY | 1109 |
| L2: DTS | 1110 |
| L3: QQWSSNP | 1111 |
| H1: GYTFTRYT | 1112 |
| H2: INPSRGYT | 1113 |
| H3: ARYYDDHYCLDY | 114 |
| Stabilized VARIANT of OKT3 (CD3 binding) | |
| L1: SSVSY | 1115 |
| L2: DTS | 1116 |
| L3: QQWSSNP | 1117 |
| H1: GYTFTRYT | 1118 |
| H2: INPSRGYT | 1119 |
| H3: ARYYDDHYSLDY | 1120 |
| Humanized VARIANT of OKT3 (CD3 binding) short | |
| L1: SSVSY | 1121 |
| L2: DTS | 1122 |
| L3: QQWSSNP | 1123 |
| H1: GYTFTRYT | 1124 |
| H2: INPSRGYT | 1125 |
| H3: ARYYDDHYSLDY | 1126 |
| Humanized VARIANT of OKT3 (CD3 binding) long | |
| L1: SASSSVSYMN | 1127 |
| L2: DTSKLAS | 1128 |
| L3: QQWSSNPFT | 1129 |
| H1: GYTFTRYTMH | 1130 |
| H2: YINPSRGYTN | 1131 |
| H3: YYDDHYSLDY | 1132 |
| HD37 (CD19 binding) short | |
| L1: QSVDYDGDSYL | 1133 |
| L2: DAS | 1134 |
| L3: QQSTEDPWT | 1135 |

TABLE S1-continued

CDR sequences CD3 and CD19 antigen binding constructs

| Antigen binding constructs CDR sequence | SEQ ID NO: |
|---|---|
| H1: GYAFSSYW | 1136 |
| H2: IWPGDGDT | 1137 |
| H3: RETTTVGRYYYAMDY | 1138 |
| Humanized VARIANT of HD37 (CD19 binding) short | |
| L1: QSVDYEGDSYL | 1139 |
| L2: DAS | 1140 |
| L3: QQSTEDPWT | 1141 |
| H1: GYAFSSYW | 1142 |
| H2: IWPGDGDT | 1143 |
| H3: RETTTVGRYYYAMDY | 1144 |
| Humanized VARIANT of HD37 (CD19 binding) short | |
| L1: QSVDYSGDSYL | 1145 |
| L2: DAS | 1146 |
| L3: QQSTEDPWT | 1147 |
| H1: GYAFSSYW | 1148 |
| H2: IWPGDGDT | 1149 |
| H3: RETTTVGRYYYAMDY | 1150 |
| HD37 (CD19 binding) long | |
| L1: KASQSVDYDGDSYL | 1151 |
| L2: DASNLVS | 1152 |
| L3: QQSTEDPWT | 1153 |
| H1: GYAFSSYWMN | 1154 |
| H2: QIWPGDGDTN | 1155 |
| H3: RETTTVGRYYYAMDY | 1156 |
| Humanized VARIANT of HD37 (CD19 binding) long | |
| L1: RASQSVDYEGDSYL | 1157 |
| L2: DASNLVS | 1158 |
| L3: QQSTEDPWT | 1159 |
| H1: GYAFSSYWMN | 1160 |
| H2: QIWPGDGDTN | 1161 |
| H3: RETTTVGRYYYAMDY | 1162 |
| Humanized VARIANT of HD37 (CD19 binding) long | |
| L1: RASQSVDYSGDSYL | 1163 |
| L2: DASNLVS | 1164 |
| L3: QQSTEDPWT | 1165 |
| H1: GYAFSSYWMN | 1166 |

TABLE S1-continued

CDR sequences CD3 and CD19 antigen binding constructs

| Antigen binding constructs CDR sequence | SEQ ID NO: |
|---|---|
| H2: QIWPGDGDTN | 1167 |
| H3: RETTTVGRYYYAMDY | 1168 |

Example 2: Description, Expression and Purification of Exemplary Bi-Specific Antigen-Binding Anti-CD3-CD19 Constructs in a Hybrid Heterodimer Fc Format or in Full-Size Antibody Format Additional bi-specific anti-CD3-CD19 antigen-binding constructs 1853, 6754, 10151, 6750, 6751, 6475, 6749, 10152, 10153, and 6518 were prepared as described in Example 1. These constructs are based on the same antigen-binding domains as variant 875 but have been engineered for improved yield and biophysical properties. The modifications include changing one or both scFvs to the equivalent Fab format and/or stabilization of the scFv by VL-VH disulfide engineering and stabilizing CDR mutations. The details of the variant compositions are shown in Table 2.

v6475 and v10153 have an anti-CD3 (OKT3) with Cysteine to Serine mutation at position 100A of the VH CDR3.

Details of the cloning, expression and characterization of hybrid and full sized anti-CD3-CD19 antigen-binding constructs are provided in PCT/US2014/046436.

The clones that correspond to each bi-specific anti-CD3-CD19 and antigen-binding construct are shown in Table XX, and the corresponding sequence composition of each clone is shown in Table YY.

Controls v891 has a polypeptide sequence that is identical to blinatumomab (BiTE™) and includes an anti-CD3 scFv and anti-CD19 scFv (50 kDa).

Variant 4371 is a bivalent monospecific anti-CD19 antibody (used in Seattle Genetics' anti-CD19 antibody-drug conjugate known as SGN-19A denintuzumab mafodotin.)

TABLE 2

Summary of Variants and Composition

| | Variant # WT Fc (FcgR knock-out) * | Chain 1 | Chain 2 |
|---|---|---|---|
| Dual scFv heterodimer | 875 (1661) | αCD3_OKT3 scFv | αCD19_HD37 scFv |
| | 873 | αCD3_blinatumomab scFv | αCD19_HD37 scFv |
| Fc variants | 1653 | αCD3_OKT3 scFv (CDR C->S) | αCD19_HD37 scFv |
| Hybrid heterodimer | 1853 (6754) | αCD3_Teplizumab Fab | αCD19_HD37 scFv |
| | N5 (10151) | αCD3_Teplizumab Fab | αCD19_HD37 scFv (VHVL SS) |
| Fc variants | 6750 (6751) | αCD3_OKT3 scFv | αCD19_HD37 Fab |
| | 6475 (6749) | αCD3_OKT3 scFv (CDR C->S) | αCD19_HD37 Fab |
| | N7 (10152) | αCD3_OKT3 scFv (VLVH SS) | αCD19_HD37 Fab |
| | N11 (10153) | αCD3_OKT3 scFv (CDR C->S) (VLVH SS) | αCD19_HD37 Fab |
| | 6476 | αCD3_blinatumomab scFv | αCD3_HD37 Fab |
| Full size mAb | 6518 (N12) | αCD3_Teplizumab Fab | αCD19_HD37 Fab |

* All variants have the following CH3 mutations: Chain 1: T350V_L351Y_F405A_Y407V; Chain 2: T350V_T366L_K392L_T394W Variants in brackets refer to the equivalent Fc knockout variant that include the additional mutations D265S_L234A_L235A on both heavy chains. This abolishes binding of the Fc to FcγRs.

The anti-CD19 scFv and anti-CD3 scFv sequences were generated as described above. The anti-CD19 Fab (HD37 Fab) is a chimeric Fab using the HD37 VH and VL sequences fused to human IgG1 CH and CL sequences respectively. The scFv or VH-CH domains are fused to one chain of the heterodimeric Fc. The anti-CD3 Fab (tepizumab Fab) was generated from the known sequence of humanized OKT3 antibody teplizumab (Eli Lilly). The VH-CH domain was fused to one chain of the heterodimeric Fc.

The scFv disulfide engineering strategy (VHVL SS) for both the anti-CD3 and anti-CD19 scFvs utilized the published positions VH 44 and VL 100, according to the Kabat numbering system, to introduce a disulphide link between the VH and VL of the scFv [Reiter et al., Nat. Biotechnol. 14:1239-1245 (1996)].

The following variants contain a mutation to the anti-CD3 scFv to improve stability and yield, as reported previously [Kipriyanov et al., Prot. Eng. 10(4):445-453 (1997)]. v1653, In some experiments, polyclonal human IgG is used as a control and is referred to as v6249.

Example 3. Humanization and Stabilization of Anti-CD3 and Anti-CD19 Antibodies

The known murine and humanized anti-CD3 and CD19 antibodies BiTE™ antibody (Kipriyanov et. al., 1998, Int. J Cancer: 77, 763-772), anti-CD3 monoclonal antibody OKT3 (Drug Bank reference: DB00075), anti-CD3 monoclonal antibody teplizumab (Drug Bank reference: DB00075) and anti-CD19 monoclonal antibody HD37 (Kipriyanov et. al., 1998, Int. J Cancer: 77, 763-772; Pezzutto, A. et al., 1986, Leukocyte Typing II. Vol. 2. Springer-Verlag. Heidelbergl-NewYork. P. 391.) exhibit low production yield and biophysical stability.

To improve the yield and biophysical properties of the HD37 and OKT3 based antibodies we used a structure guided approach for humanization and stabilization. This approach is based on the humanization and stabilization method as described by Ewert et al., (Ewert et al., Methods 34 (2004) 184-199) and in addition includes detailed analysis of the VH/VL three dimensional structures to identifying potential VH/VL framework positions responsible for the low stability. Further, the framework and CDR sequences were analyzed for potential sites of post-translational modifications, including de-ami dation, aspartate isomerization and protease cleavage.

The engineered humanized anti-CD3 and anti-CD19 VL and VH sequences and the sequence alignment to the known parental murine antibodies HD37 and OKT3 and the humanized teplizumab are shown in FIGS. 2 and 4 respectively. Critical positions identified by the structure guided human-humanized HD37 Fab is a Fab composed of the humanized HD37 VH and VL sequences hVH2 and hVL2(D-E) (FIG. 2) fused to human IgG1 CH and CL sequences respectively. The humanized HD37 scFv is composed of the humanized HD37 VH and VL sequences hVH2 and hVL2(D-E) (FIG. 2) and has the identical VH/VL orientation and linker as described for v10149 above. The murine anti-CD3 scFv is identical to the scFv in the parental variant v875 (Table 1) and the humanized anti-CD3 scFvs were generated from the engineered VH and VL sequences as described in FIG. 4 and Table 3.

(VLVH SS) indicates disulfide stabilized scFv utilizing the published positions VH 44 and VL 100, according to the Kabat numbering system, to introduce a disulphide link between the VH and VL of the scFv [Reiter et al., Nat. Biotechnol. 14:1239-1245 (1996)].

TABLE 3

Summary of Variants and Composition

| Bispecific variant # | Anti-CD19 chain on heavy chain A | Anti-CD3 chain on heavy chain B | VH/VL mutations for improved stability |
|---|---|---|---|
| v10149 | murine HD37 scFv (VLVH SS) | murine OKT3 scFv (VLVH SS) | Original murine HD37 and OKT3 VH/VL sequences |
| v12043 | murine HD37 scFv (VLVH SS) | murine OKT3 scFv (VLVH SS) | Original murine OKT3 VH/VL sequences VHVL framework mutations for HD37 CDR mutation Asp->Glu at position 28 of HD37 VL |
| v6751 | murine HD37 Fab | murine OKT3 scFv | Original murine HD37 and OKT3 VH/VL sequences |
| v15192 | humanized HD37 Fab | humanized OKT3 scFv (hVH1/hVL1) | VHVL framework mutations for HD37 and OKT3 CDR mutation Cys->Ser at position 100A of OKT3 VH CDR mutation Asp->Glu at position 28 of HD37 VL |
| v15193 | humanized HD37 Fab | humanized OKT3 scFv (hVH1/hVL2) | VHVL framework mutations for HD37 and OKT3 CDR mutation Cys->Ser at position 100A of OKT3 VH CDR mutation Asp->Glu at position 28 of HD37 VL |
| v15194 | humanized HD37 Fab | humanized OKT3 scFv (hVH2/hVL1) | VHVL framework mutations for HD37 and OKT3 CDR mutation Cys->Ser at position 100A of OKT3 VH CDR mutation Asp->Glu at position 28 of HD37 VL |
| v15195 | humanized HD37 Fab | humanized OKT3 scFv (hVH2/hVL2) | VHVL framework mutations for HD37 and OKT3 CDR mutation Cys->Ser at position 100A of OKT3 VH CDR mutation Asp->Glu at position 28 of HD37 VL |
| v 17119 | humanized OKT3 scFv (hVH2/hVL2) | humanized HD37 Fab | VHVL framework mutations for HD37 and OKT3 CDR mutation Cys->Ser at position 100A of OKT3 VH CDR mutation Asp->Glu at position 28 of HD37 VL | ization and stabilization approach are underlined and highlighted in bold in FIGS. 2 and 4. The engineered humanized sequences indicated hVH/hVL were used for construction of the bispecific variants as described in Example 4.

Example 4. Expression and Purification of Bi-Specific Anti-CD19-CD3 Antigen-Binding Constructs with Improved Yield and Biophysical Properties Bispecific anti-CD3-CD19 antibodies designed for improved yield and biophysical stability were constructed as described in Table 3 and Example 3. Variant v10149 and v6751 are initial murine dual scFv heterodimer Fc and hybrid heterodimer Fc designs of the CD3-CD19 antigen-binding constructs (see Example 1 and Example 2 for further description). Variants v12043 and v15192-v15195 exemplify humanized designs that include variable domain framework and CDR modifications designed to further improve yield and biophysical properties of the CD3 and CD19 antigen-binding constructs.

The anti-CD19 murine HD37 scFv has been described in Example 1 and the Fab anti-CD19 murine HD37 is a chimeric Fab using the HD37 VH and VL sequences fused to human IgG1 CH and CL sequences respectively. The The humanized Fab and scFv sequences are fused to the heterodimer Fc chains as described for the parental murine variants in Examples 1 and 2. All variants have the following $CH_3$ mutations: Heavy chain A: T350V_L351Y_F405A_Y407V; Heavy chain B: T350V_T366L_K392L_T394W. The respective heavy chain $CH_3$ mutations can either be on the anti-CD19 chain or the anti-CD3 chain. All variants further comprise the additional mutations D265S_L234A_L235A on both heavy chains to abolish binding of the Fc to FcγRs.

Fc numbering is according to EU index as in Kabat referring to the numbering of the EU antibody (Edelman et al., 1969, Proc Natl Acad Sci USA 63:78-85); Fab or variable domain numbering is according to Kabat (Kabat and Wu, 1991; Kabat et al, Sequences of proteins of immunological interest. 5th Edition—US Department of Health and Human Services, NIH publication no. 91-3242, p 647 (1991)).

The murine HD37 and OKT3 sequences were humanized and further modified for improved yield and stability by the following changes: i) the humanized anti-CD3 scFvs can utilize the published Cysteine to Serine mutation at position 100A of the VH CDR3 [Kipriyanov et al., Prot. Eng. 10(4):445-453 (1997)] and the variants v15192-v15195 and v17119 (Table 3) contain the Serine mutation for improved stability, ii) the sequence of the humanized anti-CD19 CDR was modified at position 28 to eliminate a potential Aspartate isomeration site that could impact antigen binding, iii) specific VHVL framework positions were identified to potentially impact stability and yield (Example 3); these positions are underlined and highlighted in bold in FIGS. 2 and 4.

The clones that correspond to each bi-specific anti-CD3-CD19 and antigen-binding construct are shown in Table XX, and the corresponding sequence composition of each clone is shown in Table YY.

Include Table

The bispecific antibodies against CD3 and CD19 were designed, expressed and characterized as described in PCT/US2015/011664 and in Examples 1 and 2.

Figure 6:
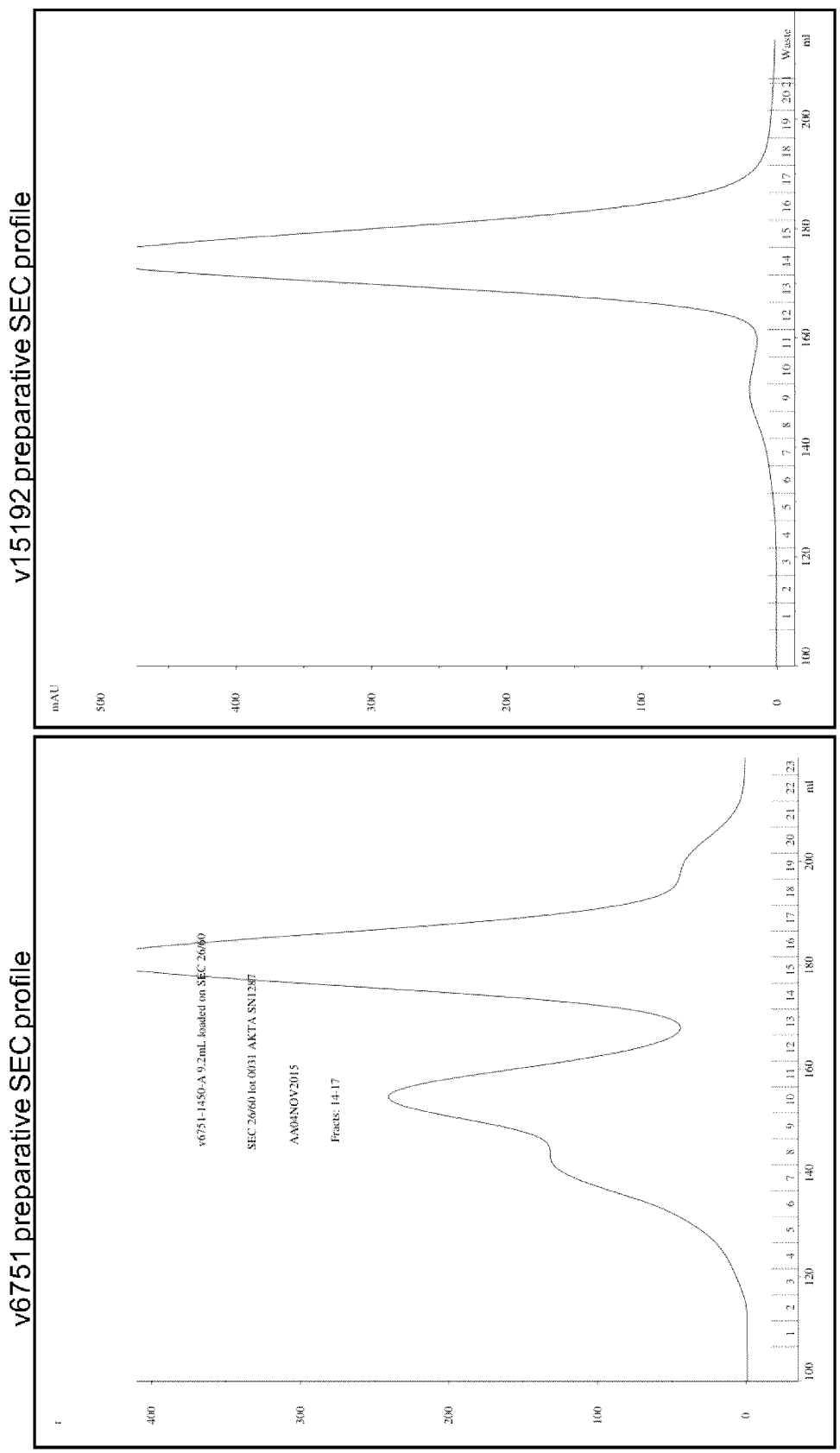
FIG. 6 depicts the SEC profile of a parental murine anti-CD3-CD19 antigen-binding construct v6751(left) and a humanized anti-CD3-CD19 antigen-binding construct v15192 (right), showing the greatly enhanced purity of v15192.

The bispecific antibodies were purified by Protein A affinity chromatography and subsequent gel filtration, as described in Example 1. FIG. 6 and Table 4 show the results of the preparative SEC purification and the final post purification yield of the initial parental murine variant v6751 and the engineered humanized variants.

The initial murine variant v6751 shows close to 50% high molecular aggregates after protein A purification and a low overall yield, while the engineered variants show minimal aggregates and 2-3-fold increased yield. The final post purification yield is comparable to positive control commercial antibodies.

TABLE 4

Production yield of humanized variants

| Sample Name | Purification process | Post pA/SEC yield (mg/L) |
| --- | --- | --- |
| v10149 | pA/SEC | 2.5 |
| v12043 | pA/SEC | 5.2 |
| v6751  | pA/SEC | 9.2 |
| v15192 | pA/SEC | 25.2 |
| v15193 | pA/SEC | 27.8 |
| v15194 | pA/SEC | 29.6 |
| v15195 | pA/SEC | 21.2 |

Example 5. Thermal Stability of Engineered Bi-Specific Anti-CD19-CD3 Antigen-Binding Constructs The thermal stability of the stability engineered bispecific anti-CD19-CD3 constructs in comparison to the murine parental variants was assessed by differential scanning calorimetry (DSC).

All DSC experiments were carried out using a GE VP-Capillary instrument. The proteins were buffer-exchanged into PBS (pH 7.4) and diluted to 0.3 to 0.7 mg/mL with 0.137 mL loaded into the sample cell and measured with a scan rate of 1° C./min from 20 to 100° C. Data was analyzed using the Origin software (GE Healthcare) with the PBS buffer background subtracted.

Table 5 shows a list of the estimated melting temperatures (Tm) for the individual anti-CD3 and anti-CD19 Fab and scFvs of the parental murine vs. the stability engineered humanized constructs.

TABLE 5

A: Thermal stability of engineered anti-CD19 binding domains

| Anti-CD19 binding domain | Tm (DSC) |
| --- | --- |
| mHD37 scFv | 53° |
| mHD37 Fab | 65° |
| hHD37 Fab (hVH2/hVL2(D-E)) | ~72°(*) |

B: Thermal stability of engineered anti-CD3 binding domains

| Anti-CD3 binding domain | Tm (DSC) |
| --- | --- |
| OKT3 scFv | 63° |
| Teplizumab Fab | 66° |
| Teplizumab scFv | ~62°(*) |
| hOKT3 scFv (hVH2/hVL2) | ~72°(*) |

Figure 7:
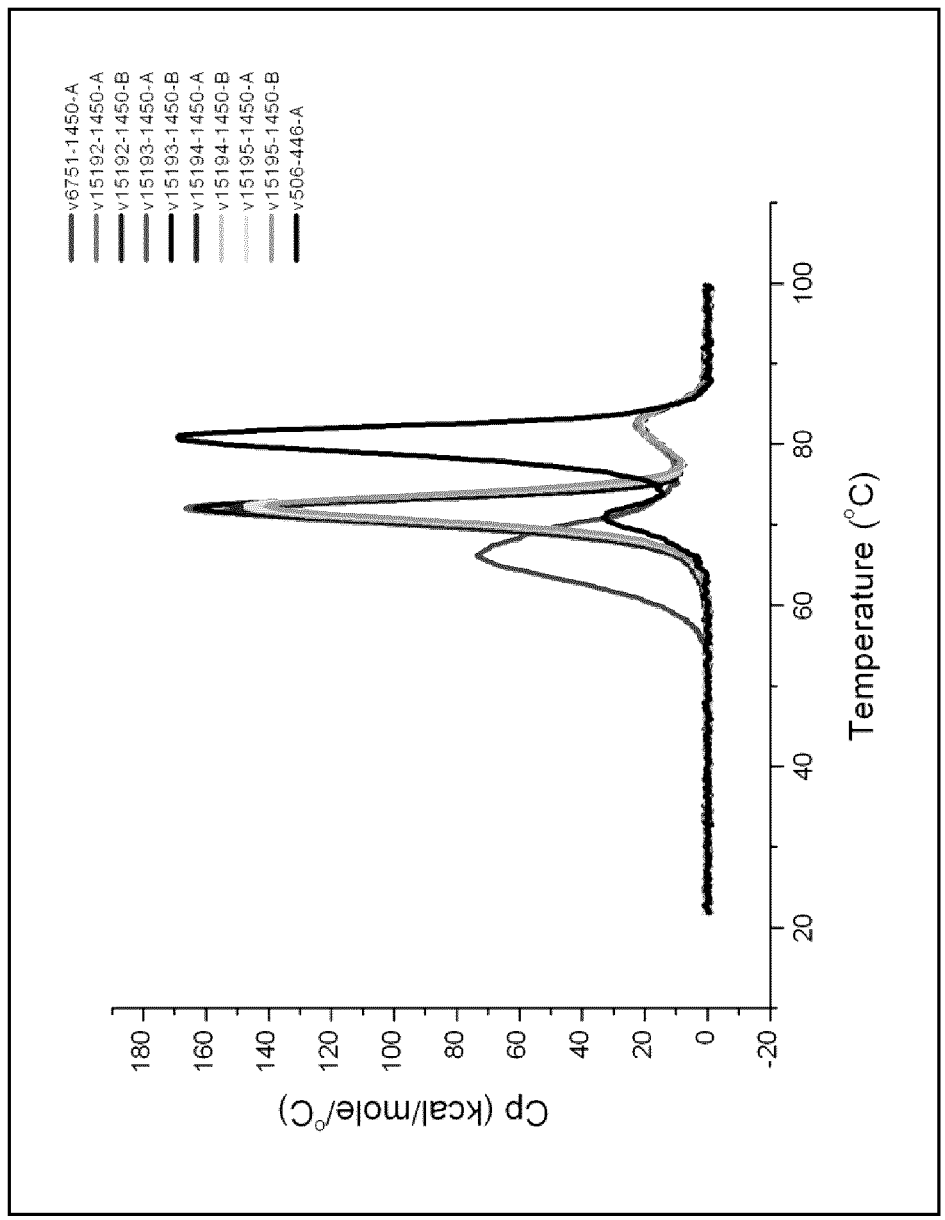
FIG. 7 depicts a DSC thermogram of exemplary humanized anti-CD3-CD19 antigen-binding constructs compared to a parental murine anti-CD3-CD19 antigen-binding construct, showing the increase in Tm of the humanized variants. Variants marked as A and B represent different production batches of the same variant.

(*)the DSC was measured on variants in IgG format; due to the overlap of CH2, Fab and scFv transitions with similar melting temperatures the specific Tm could only be estimated (see FIG. 7)

The anti-CD19 and anti-CD3 Fabs and scFvs were constructed as described above (Examples 1 and 4), expressed as bispecific or monospecific Fc constructs and the purified constructs were measured by DSC as described. FIG. 7 illustrates a representative DSC thermogram of selected engineered variants vs. the parental murine control. The melting transitions of the individual domains as summarized in Table 5 were estimated by comparison of the engineered vs. the parental murine DSC thermograms.

The results in Table 5 and FIG. 7 show that the humanized constructs with engineered variable domains have increased stability compared to their murine parental constructs. The final stabilized hybrid variants v15192-v15195 have thermal melting temperatures of over 72° C., comparable to Fabs of commercial IgG antibodies.

As illustrated in Table 4 and 5, the structure guided stability engineering yields a significant improvement in expression and thermal stability. Further, comparison to the humanized Teplizumab shows that the improvement in yield and stability is independent of the sequence humanization, but is most likely due to specific changes to VH/VL positions that we have identified by our structure guided approach as critical for the Fab/scFv stability.

In conclusion, our structure guided humanization and stabilization approach has identified new humanized OKT3 and HD37 VH/VL sequences with significantly improved yield and stability. In difference to the known murine and humanized HD37 and OKT3 scFvs, which exhibit low expression and stability, our engineered variants show yield and stability comparable to commercial IgG and thus allow the development as therapeutic antibodies.

Example 6. Antigen Binding of Engineered Bi-Specific Anti-CD19-CD3 Antigen-Binding Constructs To determine whether the engineered bispecific constructs v15192-v15195 bind to CD19 and CD3 antigens equivalent to the parental murine construct v6751, the binding affinity to CD19 and CD3 was measured by SPR and whole cell FACS as described below.

All SPR binding experiments were carried out using a BioRad ProteOn XPR36 instrument at 25° C. with 10 mM HEPES, 150 mM NaCl, 3.4 mM EDTA, and 0.05% Tween 20 at pH 7.4. Recombinant CD3epsilon/delta Fc fusion protein (Sino Biological; http://www.sinobiological.com/CD3D-CD3-Delta-Protein-g-10182.html) was captured on anti-Fc capture sensorchips. Purified antibodies were indirectly captured on the sensorchip by binding the recombinant CD3 fusion protein when injected at 25 μL/min for 240s (resulting in approx. 500 RUs) following a buffer injection to establish a stable baseline. Resultant $K_D$ values were determined from binding isotherms using the Equilibrium Fit model with reported values as the mean of three independent runs.

Table 6 summarizes the results of the SPR binding of the engineered humanized bispecific constructs v15192-v15195. All engineered constructs bind to CD19 and CD3 antigens equivalent to the parental murine construct v6751. The stability engineered humanized constructs have equivalent binding to CD3 antigen compared to the parental v6751.

TABLE 6

SPR binding of engineered anti-CD19-CD3 variants to recombinant CD3

| Sample | capture (RU) | KD (M) | Rmax (RU) |
| --- | --- | --- | --- |
| v6751 | 959.93 | 1.41E-07 | 178.72 |
| v15193 | 988.48 | 3.70E-07 | 174.01 |
| v15194 | 975.92 | 3.49E-07 | 179.12 |
| v15195 | 1032.89 | 4.27E-07 | 192.69 |

Figure 8:
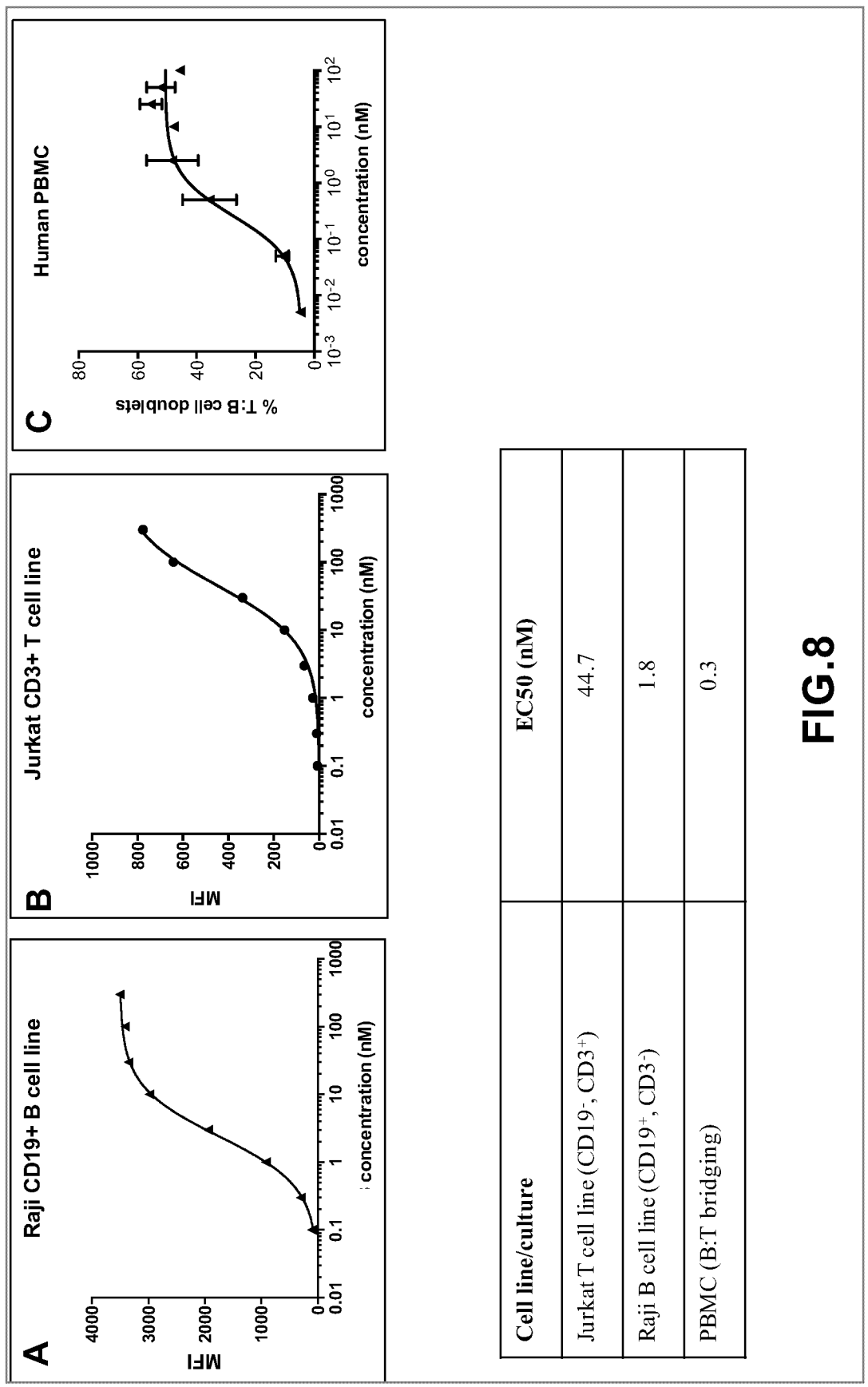
FIG. 8 depicts the binding of a humanized anti-CD3-CD19 antigen-binding construct v15195 to (panel A) Raji CD19+ B cells; (panel B) Jurkat CD3+ T cells. Panel (C) depicts the percentage of T:B cell doublets detected when v15195 is incubated with human peripheral blood mononuclear cells (PBMC). T:B cell doublets were detected as being both CD20+ and CD4+ or CD8+.

Example 7: Whole Cell Binding to CD19+ Raji Tumor Cells and CD3+ Jurkat T Cells and Human PBMCs The ability of the humanized bispecific anti-CD19-CD3 constructs to bind to CD3- and CD19-expressing cells was assessed via whole cell FACS binding analysis as described previously (PCT/US2015/011664). The binding to CD19+ Raji B cells (ATCC: CCL-86; Pulvertaft, Lancet 1964) and CD3+ Jurkat cells (Weiss, J Immunol 1984) and the apparent binding affinities of variant v15195 are shown in FIGS. 8A and B.

The bispecific anti-CD19-CD3 constructs (exemplified by v15195 in FIG. 8) bound human Raji CD19+ NHL B cells with high affinity (apparent affinity of 2.4 nM) and human CD3+ Jurkat T cells with low affinity (apparent affinity of 44.7 nM).

The ability of bispecific T cell engagers to crosslink T cells and target B cells is a prerequisite for activity. Therefore, in addition to assessing binding to isolated B and T cell lines as shown in FIGS. 8A and B we tested the ability of the bispecific anti-CD19-CD3 constructs to crosslink autologous B and T cells in human PBMC. Freshly isolated human and PBMCs were incubated with v15195 on ice and the percentage of B cell:T cell doublets were analyzed by FACS to determine the concentration dependent ability of crosslinking B and T cells. The percent T:B doublets were defined as FSC-W-high cells within the CD20+ SSClow population. Greater than 75% of the identified doublets were CD4+ or CD8+, suggesting that they had formed doublets with T cells.

As illustrated in FIG. 8C, the analysis of B:T cell doublets in human PBMC demonstrated that v15195 crosslinks B and T cells in human PBMC in a concentration dependent manner and at concentrations below 1 nM.

Together, this data shows that the bispecific anti-CD19-CD3 constructs preferentially binds B cell and crosslinks B and T cells at concentrations below 2 nM, while binding to isolated T cells at significantly lower concentrations of above 40 nM. This preferential binding of B cells and crosslinking of B and T cells at low concentrations, while only binding isolated T cells at low concentrations, allows for development of bispecific drug-conjugates that will preferentially bind B cells and activate T cells without impacting isolated T cells.

Example 8: Drug Conjugation of Bi-Specific Anti-CD19-CD3 Antigen-Binding Constructs A schematic of exemplary anti-CD3-CD19 antigen-binding construct drug conjugate is shown in FIG. 1. Anti-CD3-CD19 antigen-binding constructs were conjugated to either DM1 using the non-cleavable linker SMCC or to DM4 using the cleavable linker SPBD as described below. Variants were conjugated to either DM1 or DM4 using a one-step procedure. The starting protein sample was first exchanged into a buffer composed of 50 mM potassium phosphate pH 6.5, 50 mM NaCl and 2 mM EDTA using a PD-10 column, and adjusted to a protein concentration of 2-10 mg/ml. A 10 mM solution of SMCC-DM1 (Levena Biopharma US, San Diego, Calif.) or SPBD-DM4 (Levena Biopharma US, San Diego, Calif.) dissolved in dimethylacetamide (DMA) was then added to 7.5 molar equivalents of the protein sample. DMA was further added to a final concentration of 10% v/v and the sample was mixed briefly. The reaction mixture was incubated at 25° C. overnight with mixing. The product was then exchanged into a buffer composed of 20 mM sodium succinate pH 5.0 using a PD-10 column, and the protein concentration and drug-to-antibody ratio (DAR) were calculated based on the absorbance at 252 and 280 nm. The buffer was adjusted to a final composition of 20 mM sodium succinate, 6% w/v trehalose and 0.02% w/v polysorbate 20, pH 5.0. High performance liquid chromatography-size exclusion chromatography (HPLC-SEC) was performed to determine the purity of the ADC, using the Tosoh G3000-SWXL column (7.8 mm×30 cm), in 100 mM sodium phosphate, 300 mM sodium chloride, pH 7.0, at a flow rate of 1 ml/min.

SMCC-DM1 conjugates of v12043, v6754, 6751, 15195 and 4372 had a yield of over 70%, a purity of >85% and a drug/antibody ratio (DAR) of 2.2-3.5 as summarized in Table 7. The SPBD-DM4 conjugate of v12043 had a yield of 70% and a purity of 82%.

TABLE 7

Conjugation of bispecific anti-CD3-CD19 variants

| Variants | Conjugate | DAR | % purity | Yield |
| --- | --- | --- | --- | --- |
| 12043 | SMCC-DM1 | 2.2 | 91 | 71 |
| 12043 | SPBD-DM4 | 2.8 | 82 | 70 |
| 6754 | SMCC-DM1 | 2.5 | 85 | 75 |
| 6751 | SMCC-DM1 | 3.5 | 97 | 72 |
| 4372 | SMCC-DM1 | 3.5 | 90 | 78 |
| 15195 | SMCC-DM1 | 3.5 | 97 | 72 |

Figure 9:
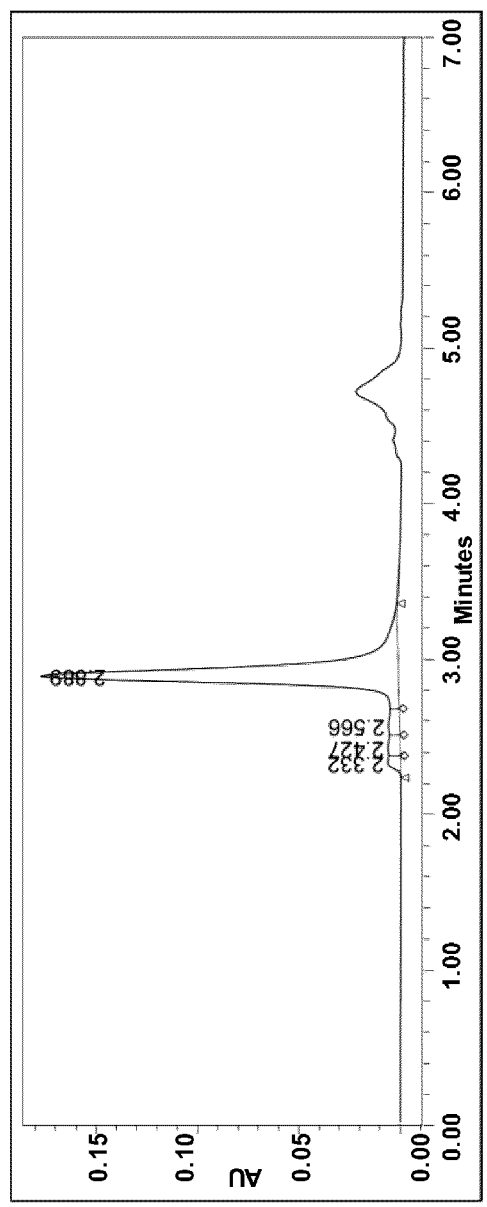
FIG. 9 depicts an exemplary UPLC-SEC profile of an anti CD3-CD19 antigen-binding construct v12043 after conjugation to the toxin DM1 using an SMCC linker.

FIG. 9 shows an exemplary UPLC-SEC profile of v12043-SMCC-DM1 after conjugation. Other variants behaved similarly.

Example 9. Impact of Bispecific Format on In Vitro Activity of Anti-CD3-CD19 Antigen-Binding Drug-Conjugates Against B and T Tumor Cell Lines To test the cytotoxicity and potency of anti-CD3-CD19 conjugates on target B cells and T cells, selected bispecific anti-CD3-CD19 conjugates with identical CDRs, but differing antigen binding format of scFv or Fab were tested in a growth inhibition assay using B and T tumor cell lines. The selected variants in FIG. 10 and Table 8 have previously been shown to have similar binding affinities to CD19 and CD3. The affinity of all selected variants to CD19 is ~2 nM, the affinity to CD3epsilon is ~40 nM.

The extent of cytotoxicity was measured in cell cultures of CD19+ Raji or Ramos (ATCC: CRL-1596; Klein, Intervirology 1975) non-Hodgkin lymphoma (NHL) target B cell lines and CD3+ Jurkat T cell line in comparison to non-specific IgG SMCC-DM1 conjugate (v6249) and monospecific anti-CD19 antibody huBU12 conjugated to SMCC-DM1 as positive control (v4371). The monospecific anti-CD19 antibody huBU12 is currently being evaluated as a MC-MMAF drug conjugate (denintuzumab mafodotin) in Phase I and Phase II clinical trials in NHL and B-ALL (Gerber, Blood 2009; Albertson™, Proceeding: AACR Annual Meeting 2014). Potential off-target cytotoxicity of the SMCC-DM1 conjugates was measured against the target cell line, K562 (ATCC: CCL-243) which does not express CD19 or CD3. The selected antibodies were diluted in media and added to the target Raji, Ramos, Jurkat or K562 cells in triplicate and incubated for 24 hr. Cells were washed, media replaced and cell survival was evaluated after a 3 day incubation at 37° C. Cell viability was measured using Sulforhodamine B with absorbance read at 510 and 540 nm following standard procedures. Data was normalized to untreated control and analysis was performed in GraphPad prism.

All anti-CD3-CD19 conjugates showed no off-target activity against the cell line K562 which does not express CD19 or CD3, similar to the non-specific IgG-SMCC-DM1 control v6249 (data not shown).

Jurkat T cells, similar to the non-specific controls v4371 and v6249. In contrast, the variant v6754 (with the anti-CD3 in Fab format and the anti-CD19 in scFv format) has similar potency on target B cells and T cells. A potential therapeutic window of killing target B cell without impacting T cells was calculated as shown in Table 8. The data suggest a therapeutic window and killing of target B cell without impacting the T cells for the variant 6751 and 12043, but not 6754.

These results show that unexpectedly, a bispecific T cell engager drug conjugate can be developed to preferentially bind and kill target B cells, while not impacting the T cells. As result of to the preferential binding and activity, the bispecific T cell engager drug conjugate has the potential to have a dual mechanism of action of: i) T cell redirected B cell killing and ii) B cell killing through internalization of the conjugated toxin payload.

Further, the data suggests the preferential behaviour is dependent on one or all of the following characteristics of the bispecific: i) monospecific targeting of the CD3 antigen, ii) low affinity binding to the CD3 antigen, iii) format and geometry of the bispecific. In conclusion, the results allow the identification of the bispecific format (including Fab vs scFv and hybrid vs. dual scFv or full size Ig bispecific and Ig isotype and hinge) and CD3e affinity as the critical parameters that have to be optimized for the development of bispecific CD3 T cell engager drug conjugates.

This conclusion and the ranking of variants with different format is confirmed in activity assays with primary T cells as described in Example 10 and also in internalization assays with tumor and T cell lines (Example 21).

TABLE 8

Cytotoxicity of selected anti-CD3-CD19 variants on B and T cells

| Rank | Variant | Format | Linker-toxin | Ramos IC50 (nM) | Jurkat IC50 (nM) | Therapeutic Window (IC50 Jurkat/Ramos) |
|---|---|---|---|---|---|---|
| 1 | 6751 | αCD3 (scFv)-αCD19 (Fab) | SMCC-DM1 | 0.4562 | 23.39 | 51.3 |
| 2 | 12043 | αCD3 (scFv)-αCD19 (scFv) | SMCC-DM1 (batch 2) | 2.982 | 26.55 | 8.9 |
| 3 | 12043 | αCD3 (scFv)-αCD19 (scFv) | SPBD-DM4 | 0.2885 | 2.121 | 7.4 |
| 4 | 12043 | αCD3 (scFv)-αCD19 (scFv) | SMCC-DM1 (batch 1) | 0.5399 | 2.496 | 4.6 |
| 5 | 4371 | αCD19 control | SMCC-DM1 | 6.025 | 24.33 | 4.0 |
| 6 | 6249 | Non-specific IgG control | SMCC-DM1 | 37.14 | 134.7 | 3.6 |
| 7 | 6754 | αCD3 (Fab)-αCD19 (scFv) | SMCC-DM1 (batch 1) | 3.974 | 0.1891 | 0.0 |
| 8 | 6754 | αCD3 (Fab)-αCD19 (scFv) | SMCC-DM1 (batch 2) | 6.251 | 0.1672 | 0.0 |

Figure 10:
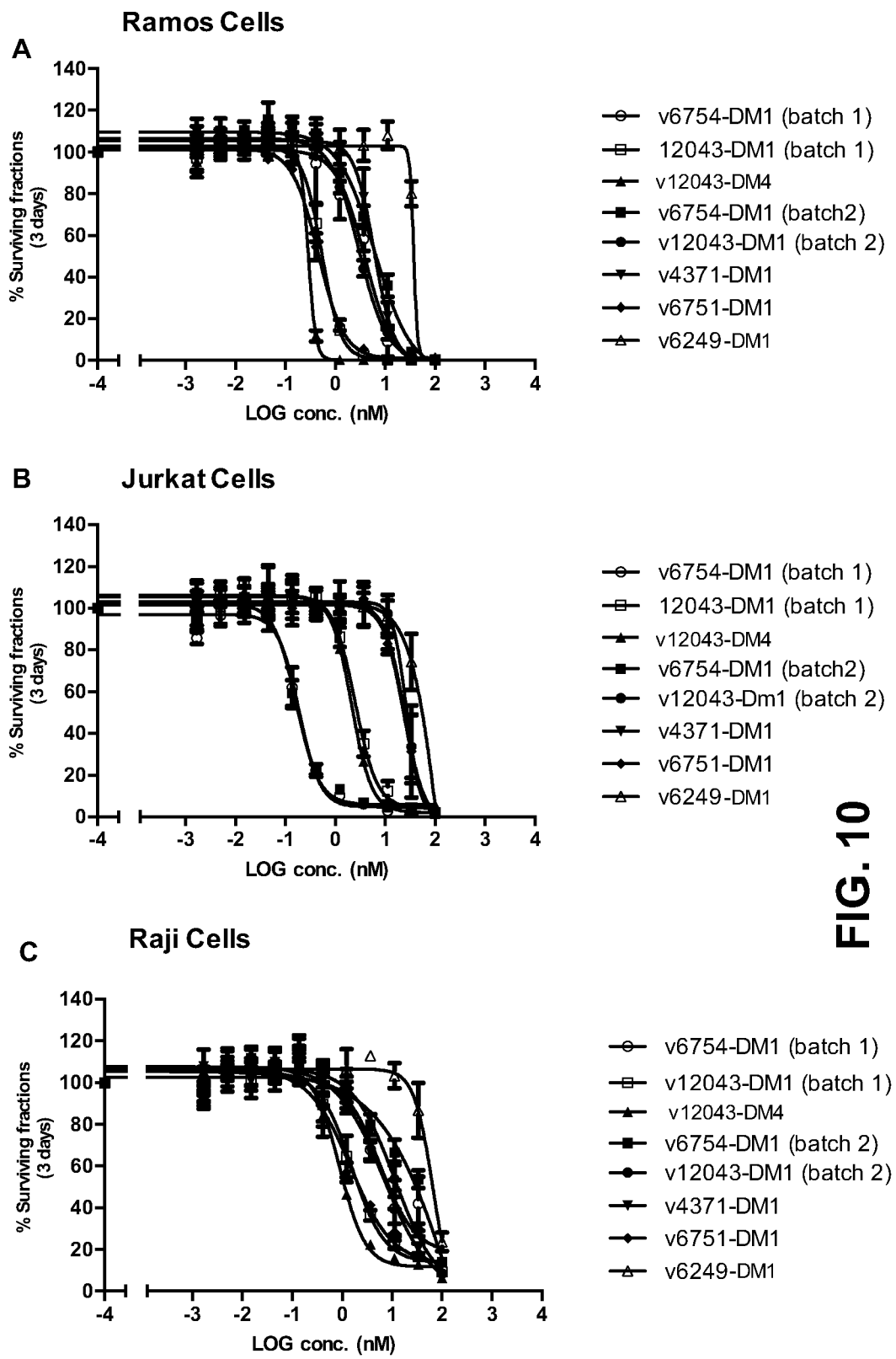
FIG. 10 depicts the results of an assay in which selected exemplary anti-CD3-CD19 variants that were conjugated to DM1 or DM4 were tested at various concentrations for their ability to inhibit the growth of (A) Ramos B cells which express CD19, (B) Jurkat T cells, which express CD3 and not CD19, and (C) Raji B cells which express CD19 but not CD3.

The growth inhibition results, as illustrated in FIG. 10 and Table 8, show unexpectedly, that the cytotoxic activity on target B cells of all monovalent anti-CD19 bispecific antibodies is comparable to or better than the bivalent monospecific anti-CD19-SMCC-DM1 control v4371. The conjugated variant 6751 has a potency of 0.45 nM on Ramos B cells and the bivalent monospecific positive control v4371 conjugate has a potency of ~6 nM.

The growth inhibition results suggest in addition an unexpected difference between the different hybrid and dual scFv anti-CD3-CD19-MCC-DM1 conjugates. Variant 6751-MCC-DM1 (with the anti-CD3 in scFv format and the anti-CD19 in Fab format) is highly active towards B cells with EC50 of 0.45 nM, while having very low activity on Example 10. In Vitro Efficacy of Exemplary Anti-CD3-CD19 Antigen-Binding Construct Drug-Conjugates in Primary Human Blood Samples To further test the preferential killing of target B cells without affecting T cells and T cell activity, the selected variants were tested in primary blood cultures with allogeneic Ramos and Raji lymphoma cell lines. This assay reflects the cytotoxic activity of the anti-CD3-CD19 conjugates towards the allogeneic target B cells mediated by the T cell redirected activity of the bispecific, and also the conjugated drug delivered by internalization of the antigen-binding construct by the target B cells. To measure the effect of the conjugates on the T cell population the T cell activity, activation and proliferation were analyzed. As relevant markers for total T cell counts CD4 and CD8 have been measured whereas T cell activation of the CD8 and CD4 T cells was measured by the established early and late T cell activation markers CD69 and CD25, respectively.

In addition, the T cell exhaustion marker PD-1 was measured to evaluate the potential effect on T cell inhibition and exhaustion. PD-1 (Programmed cell Death protein 1) functions as an immune checkpoint and plays an important role in down regulating the immune system by preventing the activation of T-cells and promoting T cell apoptosis, while reducing apoptosis in regulatory T cells (suppressor T cells) (Francisco L M, Sage P T, Sharpe A H (July 2010) *Immunological Reviews* 236: 219-42)

Human blood (120-140 mL) for individual studies was collected from donors and PBMC were freshly isolated. PBMCs were further processed to derive the subpopulations without autologous B cells (PBMC-B). Resting PBMCs were used as effector cells and Raji or Ramos human B cells as target cells and the ratio of T cells to allogeneic Raji or Ramos B cells was adjusted to an E:T ratio of 5:1. B cell and T cell populations, at day 0, were determined by FACS. Exclusive B cell markers included CD19 and CD20. T cell populations were measured by CD3, CD4 and CD8 and T cell activation and potential exhaustion was measured by CD69, CD25 and PD1, respectively as described above. Quadruplicate wells were plated for each control and experimental condition and co-cultures were incubated in 5% CO2, 37° C. and stopped at 72 hours. T and B cells were assessed for their respective proportions in the culture by FACS. The collected culture cells were stained for CD45, CD20 and 7-AAD FACS detection. FACS analysis was carried out by InCyte/FlowJo as follows: A Guava 8HT flow cytometer was used for analysis of cell subpopulations. Between 5,000 events for FSC/SSC and compensation wells, and 30,000 events for experimental wells were analyzed by cytometry. A threshold was set to skip debris and RBCs. All B cells were confirmed to be double positive for CD19 and CD20 at Day 0, which allowed for monitoring of CD20 as appropriate B cell marker. In a control experiment Raji and Ramos cell cultures without PBMC were incubated with the variants analyzed for B cell cytotoxicity after 72 hrs.

Figure 12:
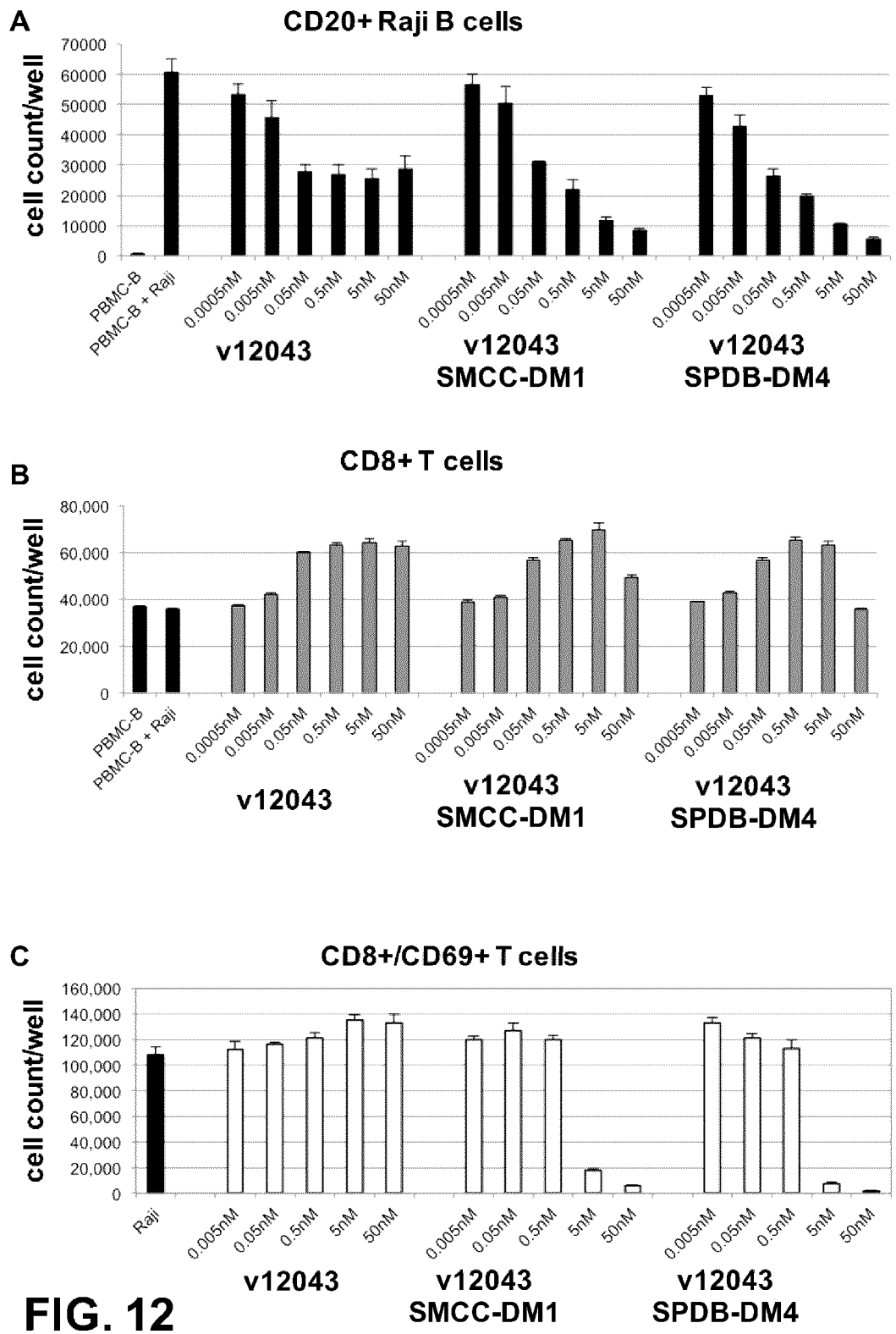
FIG. 12 depicts the results of a second experiment conducted as in FIG. 11.

FIGS. 11 and 12 show the results of an n=2 repeat with two individual PBMC donors and allogeneic Raji B cells. The non-conjugated variant v12043 has a potency of <0.05 nM on the Raji target B cells for both donors and induces T cell proliferation and activation with similar potency. The non-conjugated variant v12043 is able to deplete ~50% of target B cells by the T cell redirected mechanism. In contrast, the drug conjugates show an equivalent T cell mediated B cell depletion at concentrations below 0.5 nM, but in addition are able to further deplete the target Raji B cells at concentrations above 0.5 nM. Unexpectedly, the conjugates show only at the highest concentration of 50 nM an impact on the T cell proliferation, but do not have an impact at lower concentrations. This is in line with the data presented in FIG. 10 and Table 8.

Figure 13:
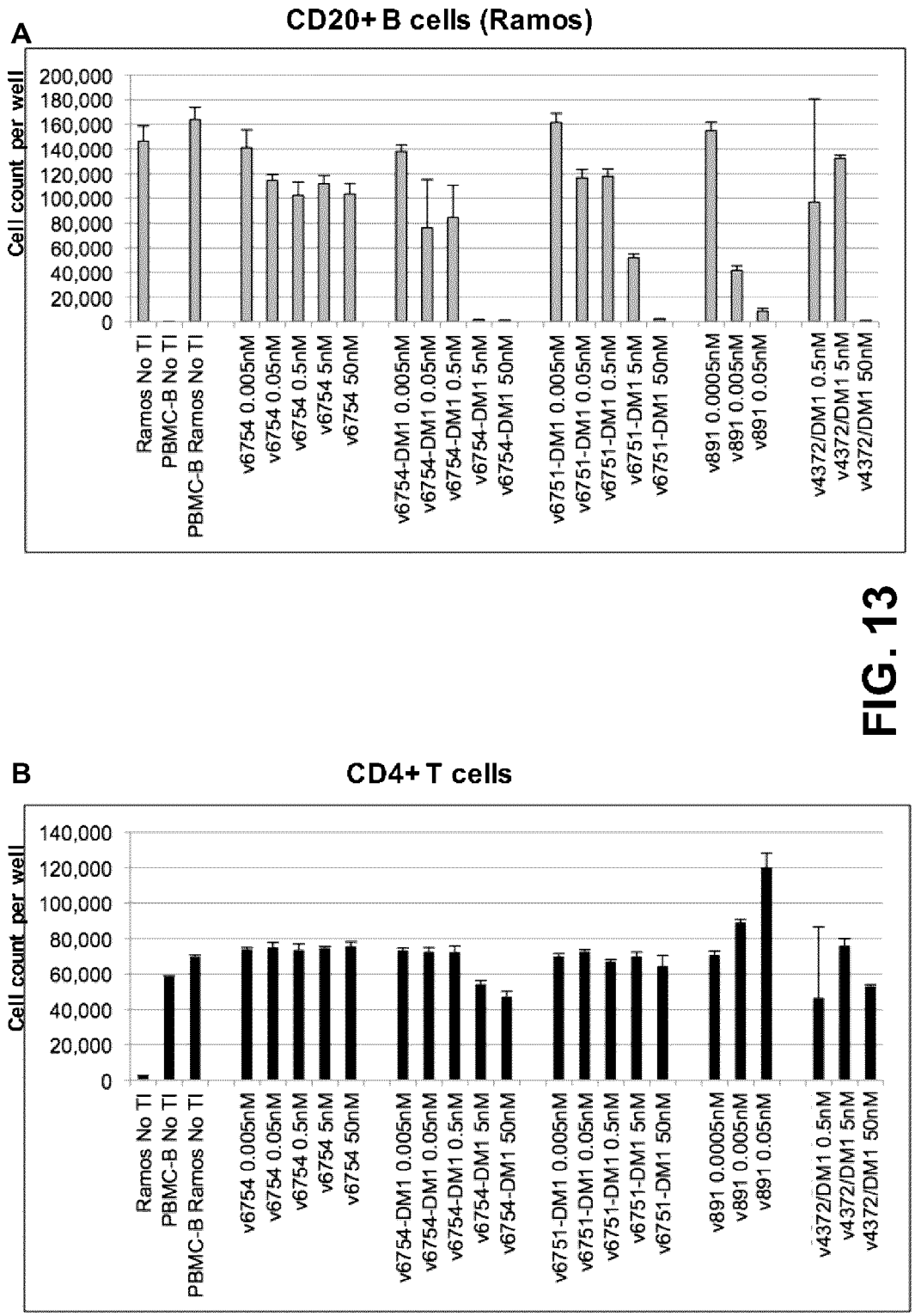
FIG. 13 depicts the effects of various concentrations of DM1-conjugated anti-CD3-CD19 variants 6754 and 6751 as well as DM1 conjugated control variants (v891, blinatumomab and v4372 bivalent monospecific anti-CD19 antibody) on (A) Ramos (CD19+) target B cells, (B) CD4+ T cells, and (C) PD-1+ T cells in 72-hour cultures of Ramos cells incubated with allogenic peripheral blood mononuclear cells that had been depleted of B cells.
Figure 14:
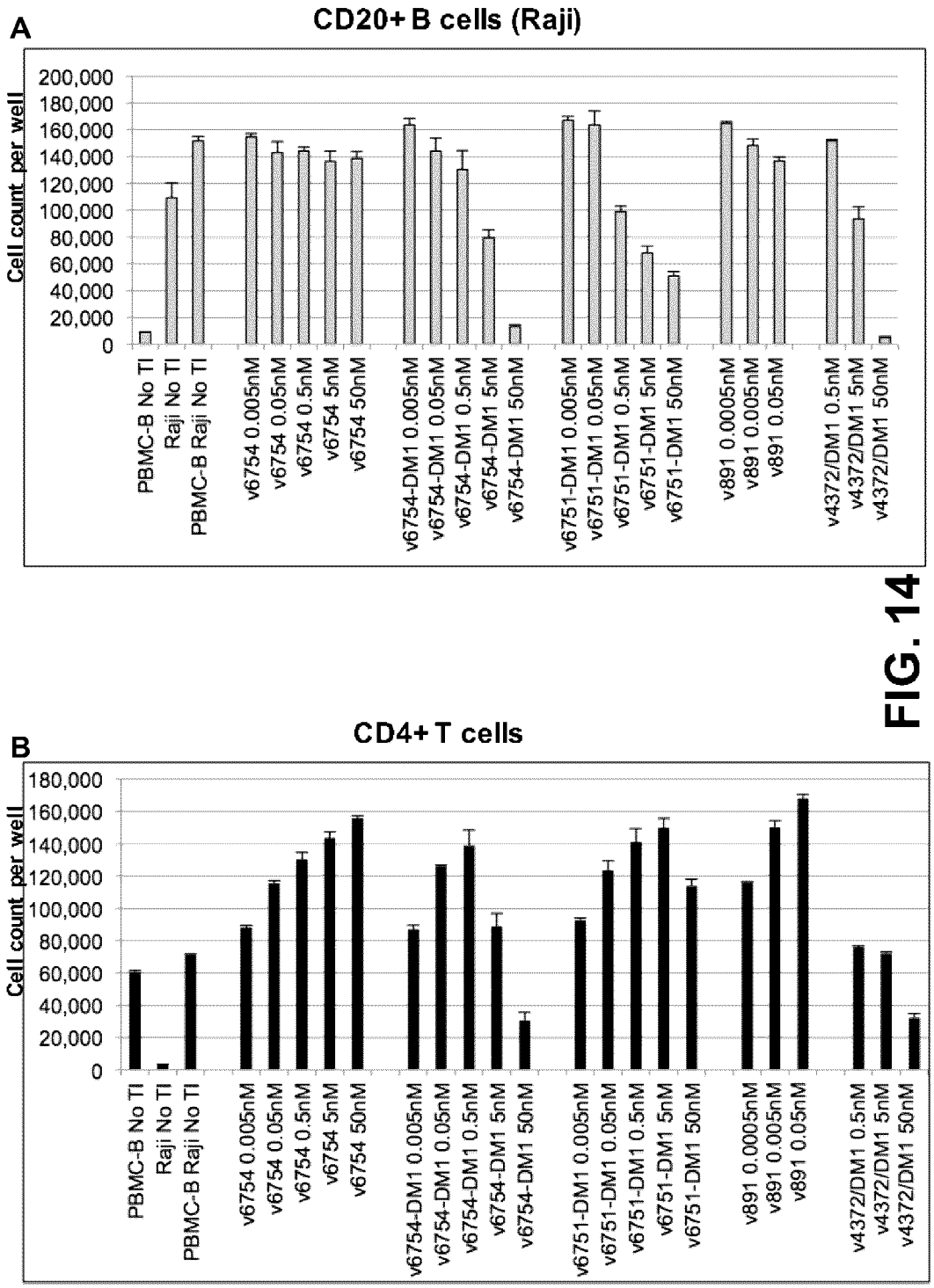
FIG. 14 depicts the results of a second experiment conducted as in FIG. 13.

FIGS. 13 and 14 show the results of a separate repeat experiment of the hybrid variants v6751 and v6754 with Raji and Ramos target B cells using fresh PBMCs from the same donor as in FIG. 12. The activity of the anti-CD3-CD19 variants is compared to the positive controls blinatumomab and the anti-CD19 monospecific conjugate. The results in FIGS. 13 and 14 show a similar additional activity of the conjugates on the target B cell depletion at higher concentrations compared to the non-conjugated v6751 and v6754. As suggested by the growth inhibition assay in FIG. 10, the assay confirms the unexpected difference of v6751 and v6754 conjugates on the T cell, with v6754 conjugate having no impact on the T cells while mediating potent killing of the target B cells.

In addition to the B cell depletion and T cell counts measured in the previous experiments (FIGS. 11 and 12), the up-regulation of PD-1 was measured. PD-1 plays an important role in down regulating the immune system by preventing the activation of T-cells and promoting T cell apoptosis (Francisco L M, Sage P T, Sharpe A H (July 2010) *Immunological Reviews* 236: 219-42). PD-1 up-regulation has been speculated to be a mechanism of resistance to T cell redirected therapies [Junttila et al., Cancer Res (2014) 5561-71; Kohnke, 2015]. As shown in FIG. 14 with PBMC and allogeneic Raji cells all variants, including the positive control blinatumomab induced up-regulation of PD-1 in >80% of T cells and no significant B cell depletion of the non-conjugated variants. The conjugated variants were able to deplete the Raji B cells at higher concentrations, but not the non-conjugated variants. In addition, the anti-CD3-CD19 conjugates in comparison to the non-conjugated comparators show a lower % of PD-1 expressing T cells at higher concentrations.T The clinical and preclinical experience of Blinatumomab indicate that the T cell redirected response is highly donor dependent and can be limited by mechanisms of T cell immunosuppression (Köhnke, 2015). As illustrated above all tested bispecifics (including blinatumomab) induced up-regulation of PD1 and in some donors the unconjugated bispecific were ineffective in depleting the target B cells. In contrast, the conjugated bispecific T cell engager showed activity in these cultures, suggesting that the dual mechanism of action can potentially overcome limited efficacy in patients with high T cell immunosuppression.

Example 11. Cytotoxicity of Bispecific Anti-CD19-CD3-SMCC-DM1 Drug Conjugates Against ALL, NHL Tumor Cell Lines Grown in Culture without T Effector Cells To test the cytotoxicity and potency of the humanized bispecific anti-CD3-CD19 variants with improved biophysical properties (see Example 3-5), selected variants were conjugated to SMCC-DM1 as described in Example 8. All SMCC-DM1 conjugates of v6751, v15192, v15193, v15194, v15195 had comparable yield of over 70%, purity of >90% and a drug/antibody ratio (DAR) of 3.1-3.5.

The extent of cytotoxicity was measured in cell cultures of different CD19+ non-Hodgkin lymphoma (NHL) and acute lymphocytic leukemia (ALL) tumor B cell lines in comparison to non-specific IgG SMCC-DM1 conjugate (Isotype DM1) and monospecific anti-CD19 antibody huBU12 conjugated to auristatin as positive control. The monospecific anti-CD19 antibody huBU12 is currently being evaluated as a MC-MMAF drug conjugate (denintuzumab mafodotin) in Phase I and Phase II clinical trials in NHL and B-ALL (Gerber, Blood 2009; Albertson™, Proceeding: AACR Annual Meeting 2014).

The impact on T cells is tested on CD3+ Jurkat T cells. Potential off-target cytotoxicity of the SMCC-DM1 conjugates was measured against the target cell line, K562 which does not express CD19 or CD3. The experiment was conducted as described in detail in Example 9.

Figure 15:
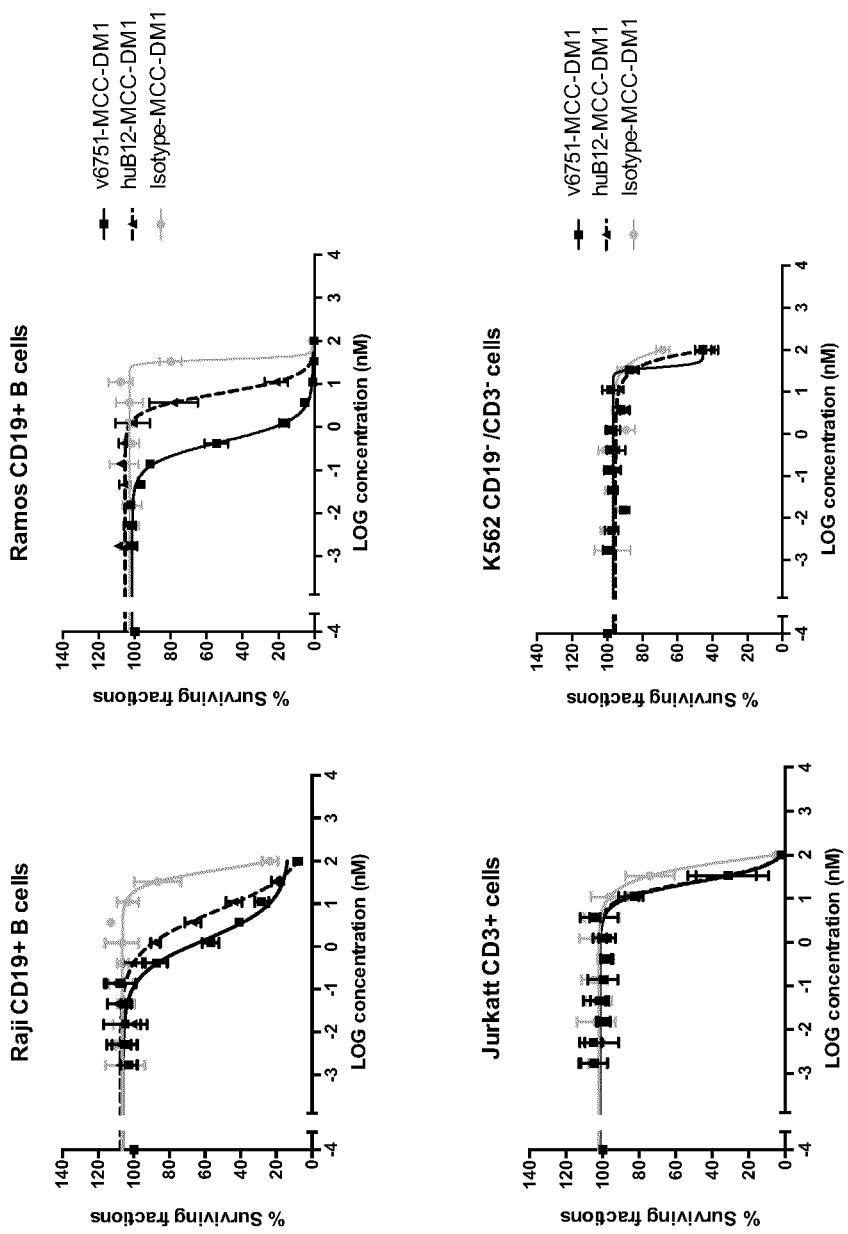
FIG. 15. Depicts the cytotoxic effect at various concentrations of an exemplary anti-CD3-CD19 antigen-binding construct v6751 conjugated to DM1 on Raji, an ALL cell line, and Ramos, an NHL cell line, Jurkat, a T cell line, and K562, a cell line that expresses neither CD19 nor CD3. Controls antibodies were a monspecific bivalent anti-CD19 antibody conjugated to DM1 huB12, and an isotype non-specific IgG conjugated to DM1.

FIG. 15 illustrates the results for a selected subset of target cell lines and Table 9 summarizes the results in comparison to the anti-CD19 antibody positive control.

TABLE 9

Cytotoxicity of MCC-DM1 drug conjugates against ALL, NHL tumor cell lines grown in culture without T cells

| Target cell line | v15195-MCC-DM1 (IC50 nM) | huBU12-MCC-DM1 (IC50 nM) |
|---|---|---|
| ALL (CD19+, CD3−) | | |
| Nalm-6 (ATCC: CRL-3273) | 0.7 | ~5 * |
| RS4; 11 (ATCC: CRL-1873) | <5 * | <5 * |
| DLBCL (CD19+, CD3−) | | |
| SUDHL-4 (ATCC: CRL-2957) | 1.2 | 4.7 |
| SUDHL-6 (ATCC: CRL-2959) | 1.8 | <5 * |
| Burkitt (CD19+, CD3−) | | |
| Raji ** | 1.5 | 6.9 |
| Ramos ** | 0.4 | 6.0 |
| Daudi (ATCC: CCL-213) | 2.1 | ~5 * |
| T-cell leukemia (CD19−, CD3+) | | |
| Jurkat | 24.3 | 23.4 |
| AML (CD19−, CD3−) | | |
| K562 (ATCC: CCL-243) | Greater than 50 nM | Greater than 50 nM |

For the results indicated with * only a 5 point concentration curve was measured and the Kd could not be fitted with confidence. The results of e.g. <5 indicates that at the concentration of 5 nM over 50% of cells were depleted. The results indicated with ** refer to data collected for the murine v6751-SMCC-DM1 conjugate.

As shown in Table 9, the bispecific anti-CD3-CD19 drug conjugates show potent killing of NHL and ALL tumor B cells lines while not significantly impacting the growth of the Jurkat T cells. All anti-CD3-CD19 conjugates showed no off-target activity against the cell line K562, which does not express CD19 or CD3, similar to the non-specific IgG-SMCC-DM1 control (data not shown).

In addition, the potency was comparable or greater than the positive control huBU12-MCC-DM1 and v15195-MCC-DM1 exhibited a wide range of target cell cytotoxic killing across human cancer cell lines.

Example 12. Cytotoxicity of Bispecific Unconjugated Anti-CD19-CD3 and Bispecific Anti-CD19-CD3-SMCC-DM1 Drug Conjugates Against Tumor Cell Lines Grown in Culture with T Cells The target B cell cytotoxic activity of the SMCC-DM1 conjugated and unconjugated variant v15195 was further evaluated in comparison to the approved therapeutic antibody Blinatumomab. The bispecific variant v15195 was specifically chosen because of the over 100 fold lower T cell redirected potency compared to Blinatumomab. This lower T cell mediated potency is sufficient to mediate target B cell killing in vitro and in vivo, while resulting in lower T cell activation and proliferation compared to Blinatumomab at 1000 fold lower concentration (see Example 14). Importantly, the lower potency yields compatible potencies for the T cell redirected and DM1 mediated cytotoxicity and enables a dual mechanism of action.

The cytotoxic activity of the bispecific anti-CD3-CD19 conjugates was measured in comparison to the non-conjugated anti-CD3-CD19 variant and the positive control Blinatumomab™ (blinatumomab, BiTE™). To measure the effect of the conjugates on the T cell population the T cell activity, activation and proliferation were further analyzed as described in Example 13. The assay was performed with n=4 primary blood donors and the experimental set-up was conducted as described above in Examples 11-14.

Figure 16:
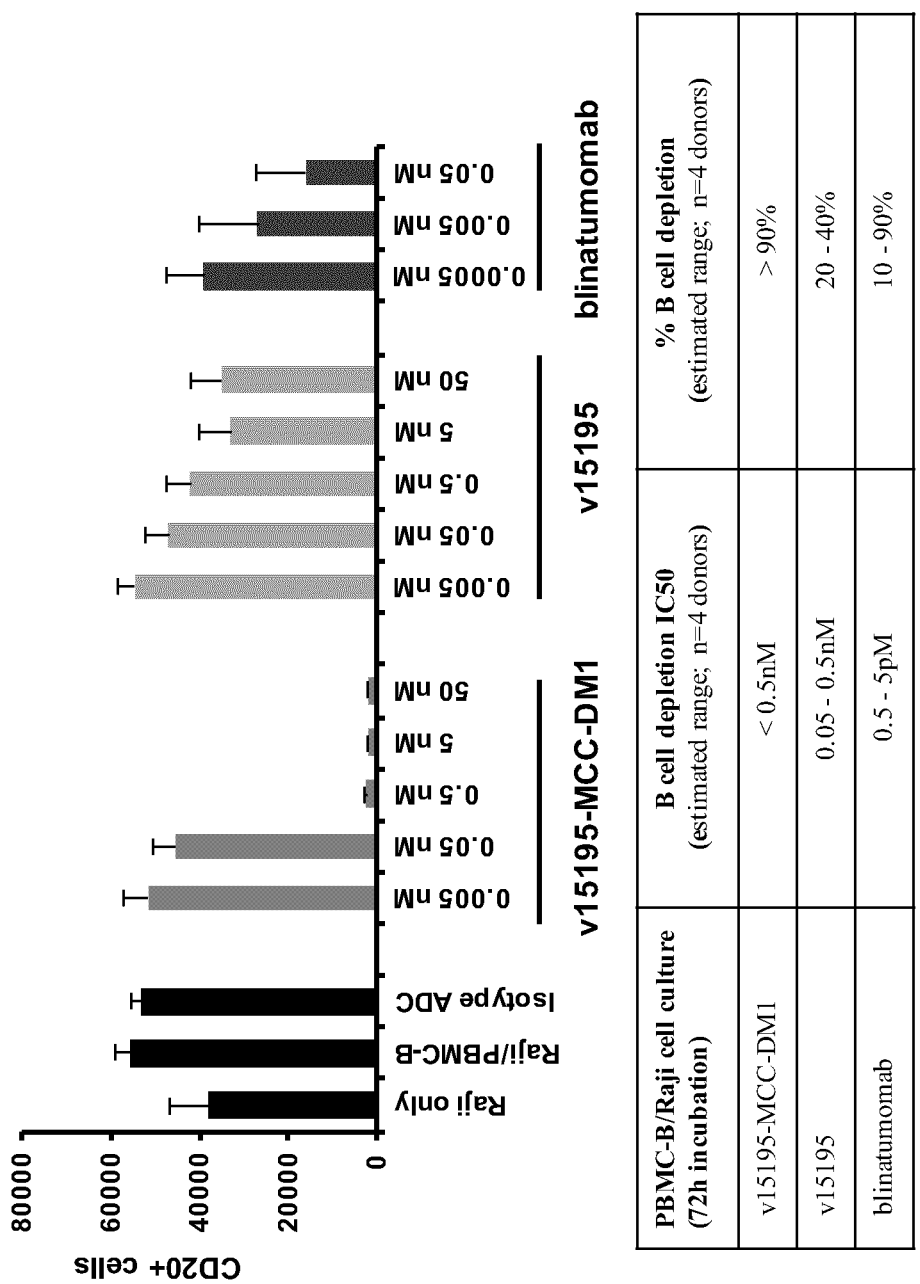
FIG. 16 depicts the effects of an exemplary anti-CD3-CD19 antigen-binding construct v15195, v15195 conjugated to DM1 and blinatumomab on Raji cells after 72 hours of culture.

As illustrated in FIG. 16, comparison of the activity of the unconjugated v15195 and the DM1 conjugated v15195 confirms that the cytotoxic activity of the anti-CD3-CD19 conjugates towards the allogeneic target B cells can be mediated by the T cell redirected activity of the bispecific, but also by the conjugated drug delivered by internalization of the antigen-binding construct by the target B cells.

Further, the results show the benefit of a dual mechanism as the T cell mediated activity of both the unconjugated v15195 and the positive control Blinatumomab at efficacious concentrations is highly donor dependent and not sufficient to kill >90% of the target B cells in this assay.

Example 13. Cytotoxicity of Bispecific Anti-CD19-CD3-SMCC-DM1 Drug Conjugate Against Tumor Cell Lines Grown in Culture with T Cells To further test the activity of the bispecific anti-CD19-CD3-SMCC-DM1 drug conjugates, the extent of cytotoxicity was measured in co-cultures of different CD19+ non-Hodgkin lymphoma (NHL) or acute lymphocytic leukemia (ALL) tumor B cell lines and primary T cells.

The variant v15195-MCC-DM1 was tested in primary blood cultures with allogeneic NHL or ALL cell line. The experimental set-up was conducted as described above in Example 12.

Figure 17:
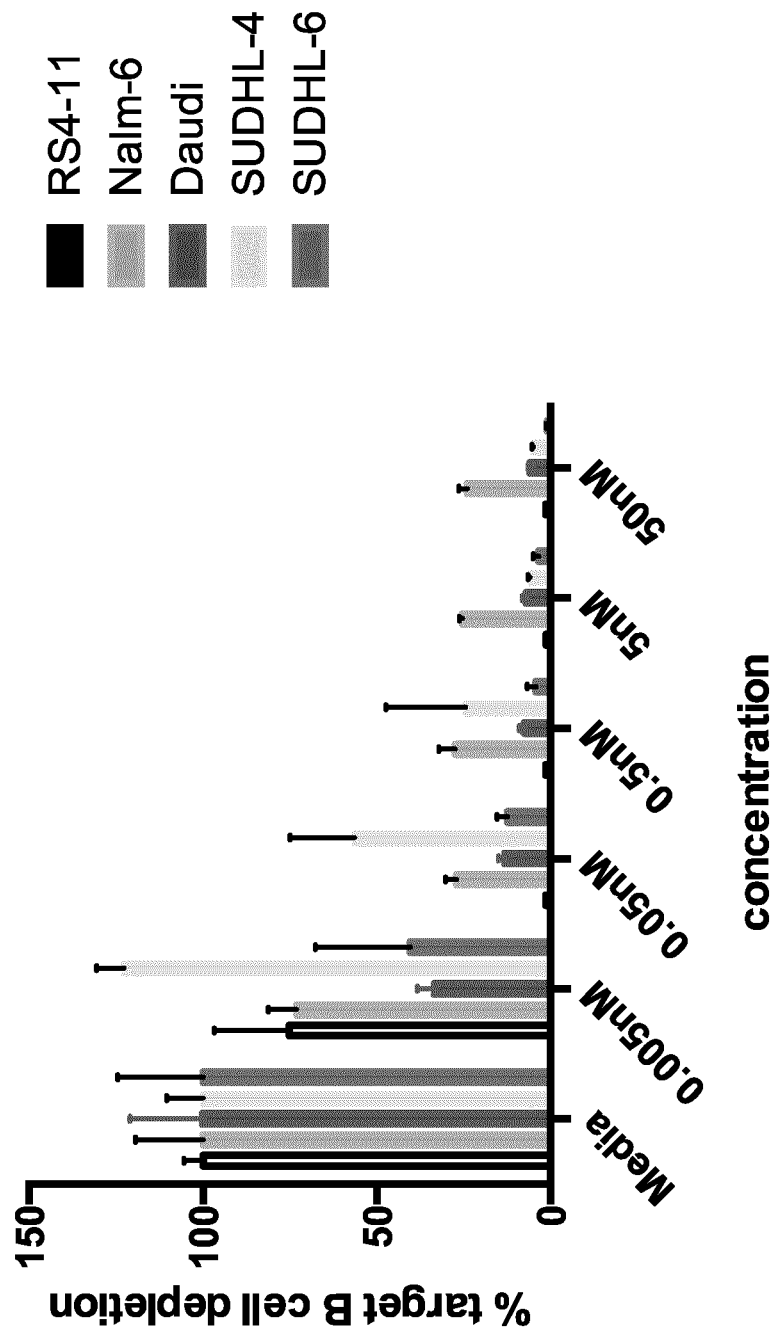
FIG. 17 depicts the effect of v15195 conjugated to DM1 at various concentrations against various ALL and NHL cell lines: RS4-11, Nalm-6, Daudi, SUDHL-4 and SUDHL-6.

FIG. 17 shows potent killing of different NHL and ALL target B cell lines by the bispecific anti-CD19-CD3-SMCC-DM1 drug conjugate and confirms preferential killing of target B cells without impacting T cells. The T cell counts are not impacted up to the highest tested concentration of 50 nM (data not shown).

Example 14. T Cell Activation and Proliferation Effects of Bispecific Anti-CD19-CD3-SMCC-DM1 Drug Conjugate in Comparison to Blinatumomab and OKT3 Antibodies The clinical dosing of the commercial therapeutic antibody Blinatumomab is limited by toxicities that are thought to be T cell mediated and associated with the extent of T cell proliferation and activation (Chatenoud, 1986; Abramowicz, 1989; Goebeler, 2011; Bargou, 2008; Topp, 2011; Klinger, 2010; International Patent Publication No. WO2011051307A1; Goebeler ME J Clin Oncol 2016; Topp, Lancet Oncol 2015)

To evaluate the potential therapeutic index of v15195, the ability of v15195 to induce T cell activation and proliferation was assessed in co-cultures of Raji cancer B cells and human PBMC and compared to the in vitro activity of Blinatumomab at a concentration equivalent to the clinically tolerated exposure. (The maximum tolerated doe (MTD) of Blinatumomab in Phase 1 r/r-NHL trial is 60 µg/m2/day (Goebeler ME J Clin Oncol 2016); for comparison to a safe dose and exposure of Blinatumomab, a concentration of 0.05 nM Blinatumomab or equivalent to the exposure at the dose of 40 µg/m2/day was chosen).

The co-culture experiment was conducted as follows: On Day 0, blood was collected from each of 4 donors and PBMCs were freshly isolated. PBMCs were further processed to derive the subpopulation of PBMC without B cells (PBMC-B). Resting PBMC-B were used as effector cells and Raji human B cells as target cells and the ratio of T cells to allogeneic Raji cells was adjusted to an E:T ratio of 5:1. The mixtures were incubated together with the antibody constructs for 3 days, after which the collected primary cells were stained for CD4, CD8, CD69, CD25 FACS detection. FACS analysis of the different populations was carried out by InCyte/FlowJo as follows: Between 5,000 event for FSC/SSC and compensation wells, and 30,000 events for experimental wells were analyzed by cytometry. A threshold was set to skip debris and RBCs.

Figure 18A:
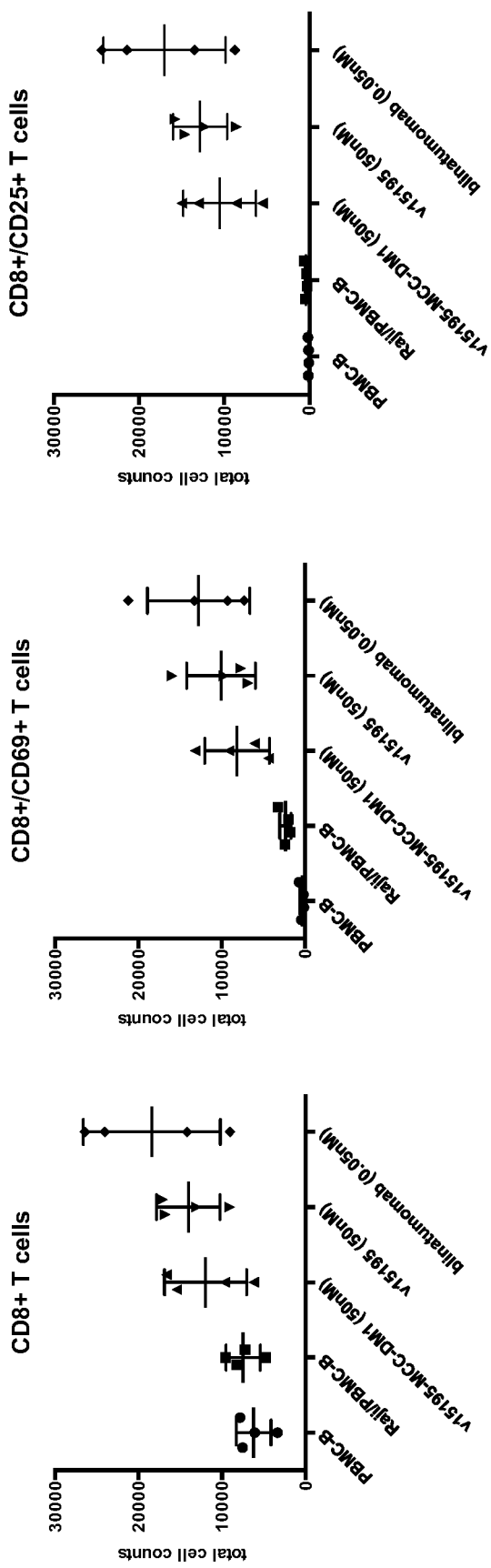
FIG. 18A depicts the effect of v15195, v15195 conjugated to DM1 and blinatumomab in cultures of Raji cells co-cultured with human PBMC on CD8+ T cells, CD8+/CD69+ T cells and CD8+/CD25+ T cells.

FIG. 18A illustrates the results from n=4 donors after 72 h incubation for the CD8+ T cell populations. The analysis shows the total CD8+ T cell counts, which is an indirect measure of the induced T cell proliferation and also the extend of T cell activation, measured by the early and late T cell activation markers CD69 and CD25 (see Example 10), respectively.

The results show that at efficacious concentrations of 100-1000 fold above the in vitro EC50 (see FIG. 16 and Example 12), v15195 induced lower T cell proliferation and activation than clinically tolerated concentrations of Blinatumomab.

Figure 18B:
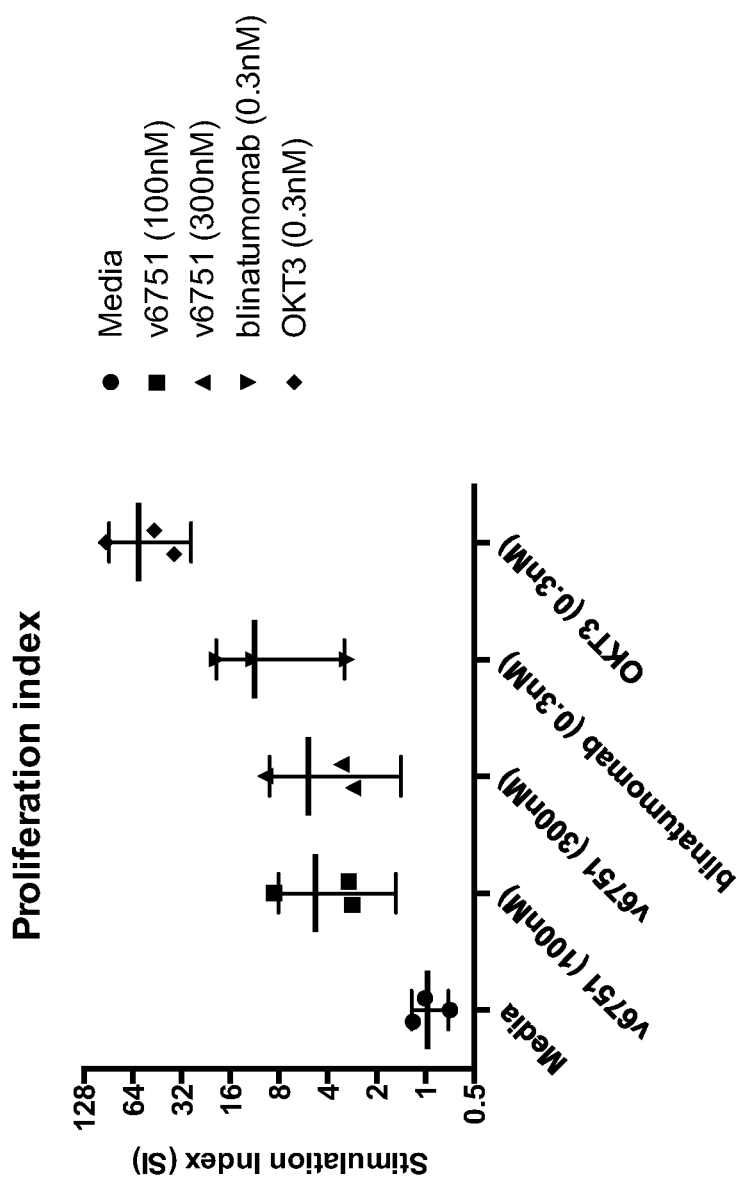
FIG. 18B depicts the proliferation observed in cultures of Raji cells co-cultured with human PBMC-B cells with v6751, blinatumomab and OKT3 antibodies.

In addition to the FACS based analysis of induced T cell proliferation and activation, the v15195 induced T cell proliferation was evaluated in a thymidine cell proliferation assay in PBMC cultures, as depicted in FIG. 18B. The thymidine based assay presents a different measure of T cell proliferation and activation as it is a measure of the total induced proliferation potential in the PBMC culture. The thymidine based analysis provides a complementary measures to the FACS based method described above. In the assay illustrated in FIG. 18B, v6751, the original parental murine variant to v15195 was used (see Table 3).

The thymidine cell proliferation assay in PBMC cultures was conducted as follows: On Day 1, blood was collected from each of 3 donors and PBMCs were freshly isolated. The test items were prepared for a final concentration of 0.3 and 100 nM and combined with the PBMCs, plated at 250,000 cells/well. The mixtures were incubated for 3 days, after which tritiated thymidine was added to the cell containing wells for a final of 0.5 µCi thymidine/well; the plates were incubated for an additional 18 hours, after which the plates were frozen. Total incubation time was 4 days. The plates were filtered and counted (CPMs) using a β-counter. From the averages, a Stimulation Index (SI) was calculated as follows and the data was tabulated: average CPM of test item/average CPM of media only. The average E:T ratio in human PBMC collected from healthy donors was ~10:1 CD3+ T cells to CD19+ B cells.

As illustrated in FIG. 18B, the comparison to Blinatumomab and OKT3 demonstrated lower total cell proliferation in cultures of v6751 even at 1000 fold higher concentrations. This suggests that the bispecific CD19-CD3 drug conjugate does not impact T cell at to the highest evaluated concentration and further that the therapeutic index is potentially higher than Blinatumomab.

Example 15: Target B Cell-Dependence of T Cell Activation by Bi-Specific Heterodimer Variants in Human PBMC The dependence of T-cell activation by the exemplary anti-CD19-CD3-SMCC-DM1 bi-specific variant v15195 on target B cells was determined in human PBMCs. The experiment was carried out as described below.

Human blood (120-140 mL) was collected from donors and PBMC were freshly isolated from donors. PBMCs were further processed to derive the subpopulation of PBMC without B cells (PBMC-B). Quadruplicate wells were plated for each control and experimental condition and PBMC cultures were incubated in 5% CO2, 37° C. and stopped at 72 hours. T cell populations were assessed by FACS. The cell pellets were resuspended in various antibody cocktails for flow cytometry analysis. A Guava 8HT flow cytometer was used for analysis of cell subpopulations. As negative controls an anti-CD19 bivalent monospecific antibody (huB12; see Example 11) and untreated cultures were used. The results are shown in FIG. 19.

The results indicate that v15195 does not activate T cells in cultures of PBMC lacking B cells, but activates T cells in presence of target B cells. Variant v15195 shows strictly target dependent T cell activation.

Example 16. T Cell Activation, Proliferation and Cytokine Release of Bispecific Anti-CD19-CD3-SMCC-DM1 Drug Conjugate v15195, in Comparison to Unconjugated v15195

The ability of the bispecific SMCC-DM1 conjugated and un-conjugated constructs to induce T cell proliferation and activation was assessed in two different assays as described below. The assay was performed with n=4 primary blood donors and the experimental set-up was conducted identical to Examples 12 and 14.

FACS analysis of T cell proliferation/activation in Raji/PBMC-B cultures: On Day 0, blood was collected from each of 4 donors and PBMCs were freshly isolated. PBMCs were further processed to derive the subpopulation of PBMC without B cells (PBMC-B). Resting PBMC-B were used as effector cells and Raji human B cells as target cells and the ratio of T cells to allogeneic Raji cells was adjusted to an E:T ratio of 5:1. The mixtures were incubated together with the antibody constructs for 3 days, after which the collected primary cells were stained for CD4, CD8, CD69, CD25 FACS detection.

Cytokine analysis of Raji/PBMC-B co-culture supernatant: Raji co-culture experiments were set-up as described above and levels of IFN-γ, IL-6 and IL-10 were assessed by luminex after 3 days of incubation.

Figure 20A:
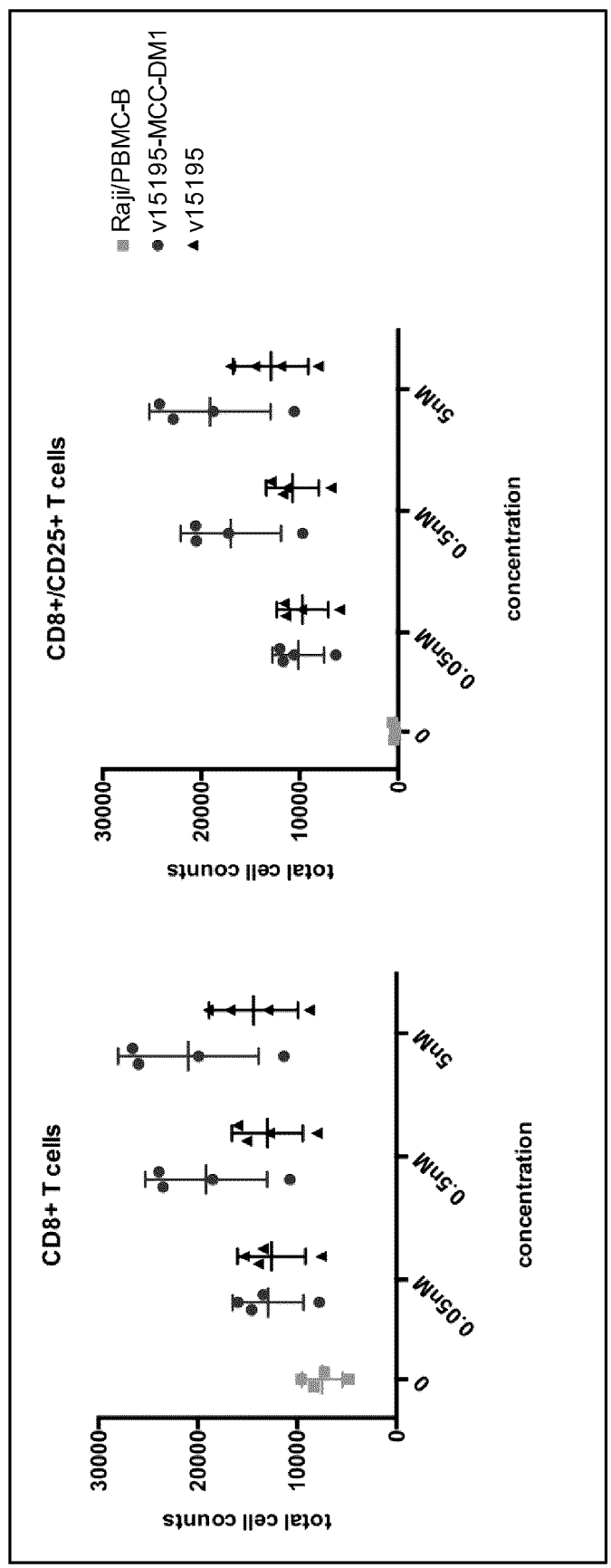
FIG. 20A depicts the effects of v15195 and v15195 conjugated to DM1 on CD8+ and CD8+/CD25+ T cells in co-cultures of Raji cells with PBMC-B cells.

The results of the FACS based analysis of T cell proliferation and activation in PBMC-B/Raji co-cultures is shown in FIG. 20A. Cytokine production is presented in FIG. 20B.

Figure 20B:
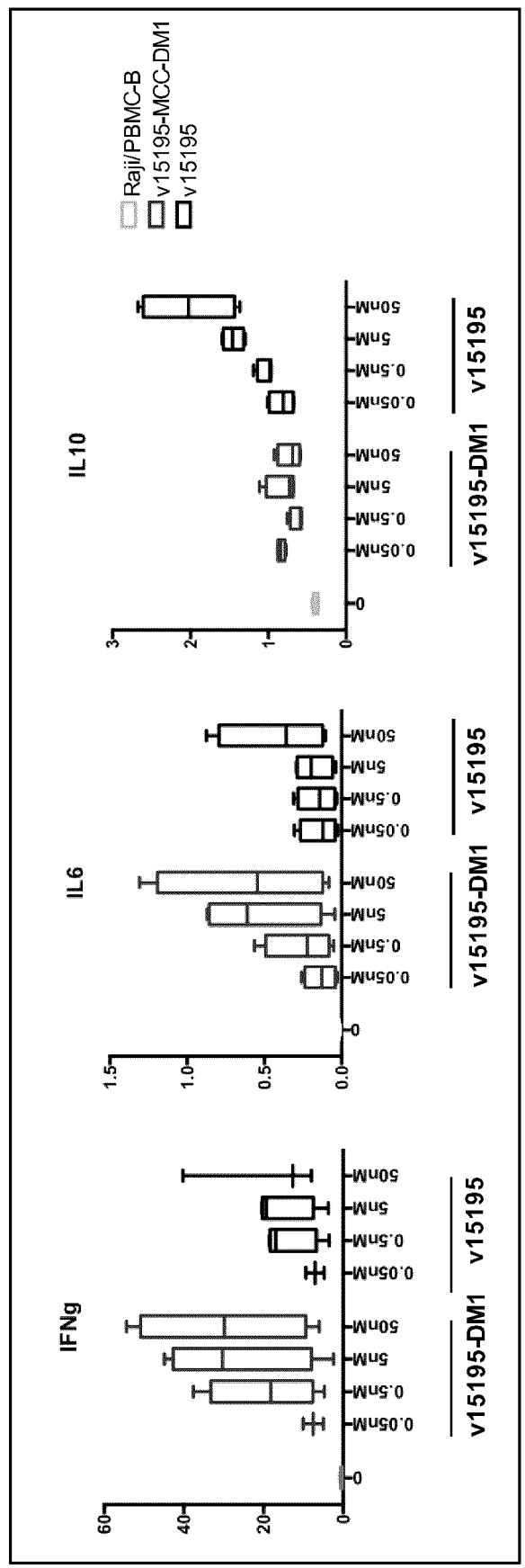
FIG. 20B depicts the level of cytokines IFNg, IL6 and IL10 in the cultures at 72 hours.

The results in FIGS. 20A and 20B illustrate that conjugation of v15195 with SMCC-DM1 enhanced T cell proliferation and activation at low concentrations, compared to unconjugated v15195. In addition, SMCC-DM1 conjugated v15195 enhanced production of the pro-inflammatory cytokines, IFN-γ and IL-6 compared to unconjugated v15195. While SMCC-DM1 conjugated v15195 only induced a modest increase in the anti-inflammatory cytokine IL-10, the unconjugated form caused a dose-dependent increase.

The difference in T cell activation and particularly cytokine profile is an unexpected and relevant result, since for example IL10 release has been associated with T cell suppressive mechanisms (e.g. regulatory T cell expansion) which limit the efficacy of T cell engagers. The bispecific T cell engager drug conjugate could therefore potentially be less susceptible to T cell suppressive mechanisms. In addition the increased release of the pro-inflammatory cytokine INFγ, which is a key regulator for T cell and macrophage activation, has the potential to synergize and enhance the T cell redirected activity.

This difference in T cell activation and cytokine release is dose dependent and correlates with the dose response of DM1 mediated target cell depletion, which suggests that the effect is mediated by the activity of the drug conjugate. As previously reported, DM1 and DM1-ADCs can mediate immunogenic cell death and are highly synergistic with immunomodulatory agents, like anti-PD1 and anti-CTLA4 (Mueller et al., Science Transl Med 2015). The results suggest that addition of a toxin like DM1 has the potential to improve the efficacy of the anti-CD19-CD3 bispecific, by inducing immunogenic/pro-inflammatory cell death (Mueller et al., Science Transl Med 2015).

Example 17. Cytotoxicity of Bispecific Anti-CD19-CD3 Conjugated to MMAE Against Tumor Cell Lines Grown in Culture with T Cells To further test the preferential killing of target B cells without affecting T cells, v15193 was conjugated to the toxin MMAE using a cleavable linker (maleimidocaproyl-valine-citrulline-p-aminobenzyloxycarbonyl (mc-vc-PABC)). The cytotoxic activity of the bispecific anti-CD3-CD19 conjugates was measured in comparison to the non-conjugated anti-CD3-CD19 variant in primary blood cultures with allogeneic Ramos lymphoma cell lines. Possible cytotoxicity towards T cells as a result of drug conjugation using a cleavable linker was also assessed.

To prepare the antibody drug conjugate, the antibody was first bound to a "Lock-Release" resin (ADCR01, ADC Biotechnology Ltd.), a proprietary resin for immobilization of antibodies for conjugation, at 1 mg/100 μL resin loading. Antibody disulfide binds were then reduced by addition of a solution of tris(carboxyethyl)phosphine (TCEP) in PBS (pH7.4) with 2 mM EDTA to the bound antibody at 6 molar equivalents of TCEP to bound antibody and incubation of the mixture at 20° C. for 120 minutes with continuous mixing. Excess TCEP was removed by washing (x3) with PBS (pH7.4).

For conjugation, a solution of mc-vc-PABC-MMAE (ADC Biotechnology Ltd., see structure below) (10 mM stock in dimethyl acetamide (DMA)) equivalent to 6 molar equivalents of linker-toxin to bound antibody was first prepared in PBS containing 5% (v/v) DMA. This linker-toxin solution was added to the bound antibody and the mixture incubated at 20° C. for 60 minutes with continuous shaking.

Following conjugation, excess linker-toxin solution was removed by centrifugation of the resin at 14800 rpm for 2 minutes. The resin was then washed three times with PBS containing 5% (v/v) DMA to remove any residual linker-toxin, followed by three washes with PBS (pH 7.4) to remove any remaining DMA co-solvent. The antibody-drug conjugate was released from the resin by incubating the resin for 15 minutes in Release buffer (ADC Biotechnology Ltd.) followed by centrifugation at 14800 rpm for 2 minutes. The filtrate was then desalted by G25 gel permeation chromatography (GE Healthcare Illustra™ NAP™-5 column) into a buffer containing 10 mM sodium acetate, 9% sucrose (pH 5.0), followed by filtration through a sterile 0.22 μm PES membrane.

Purity of the final antibody-drug conjugate was assessed by high performance liquid chromatography-size exclusion chromatography (HPLC-SEC) on a TSKgel G3000SWXL 7.8 mm×30 cm, 5 μm column (TOSOH Bioscience LLC) in 10% IPA, 0.2M potassium phosphate, 0.25M potassium chloride, pH 6.95 at a flow rate of 0.5 mL/min. The drug-to-antibody ratio (DAR) of the antibody-drug conjugate was determined using hydrophobic interaction chromatography (HIC) HPLC on a Butyl-NPR 4.6 mm×3.5 cm, 2.5 μm column (TOSOH Bioscience LLC) run at 0.8 mL/min with a 12-minute linear gradient of A—1.5M $(NH_4)_2SO_4$, 25 mM NaPi, pH 6.95 and B—25 mM NaPi, pH 6.95, 25% IPA.

The final yield of the v15193-mc-vc-PABC-MMAE conjugate was 39%, with a purity of >98% and an average DAR of 3.7.

To measure the effect of the conjugate on the T cell population, the T cell activity, activation and proliferation were further analyzed as described in Example 14. The assay was performed with n=1 primary blood donors and the experimental set-up was conducted as described above in Example 12.

Figure 21:
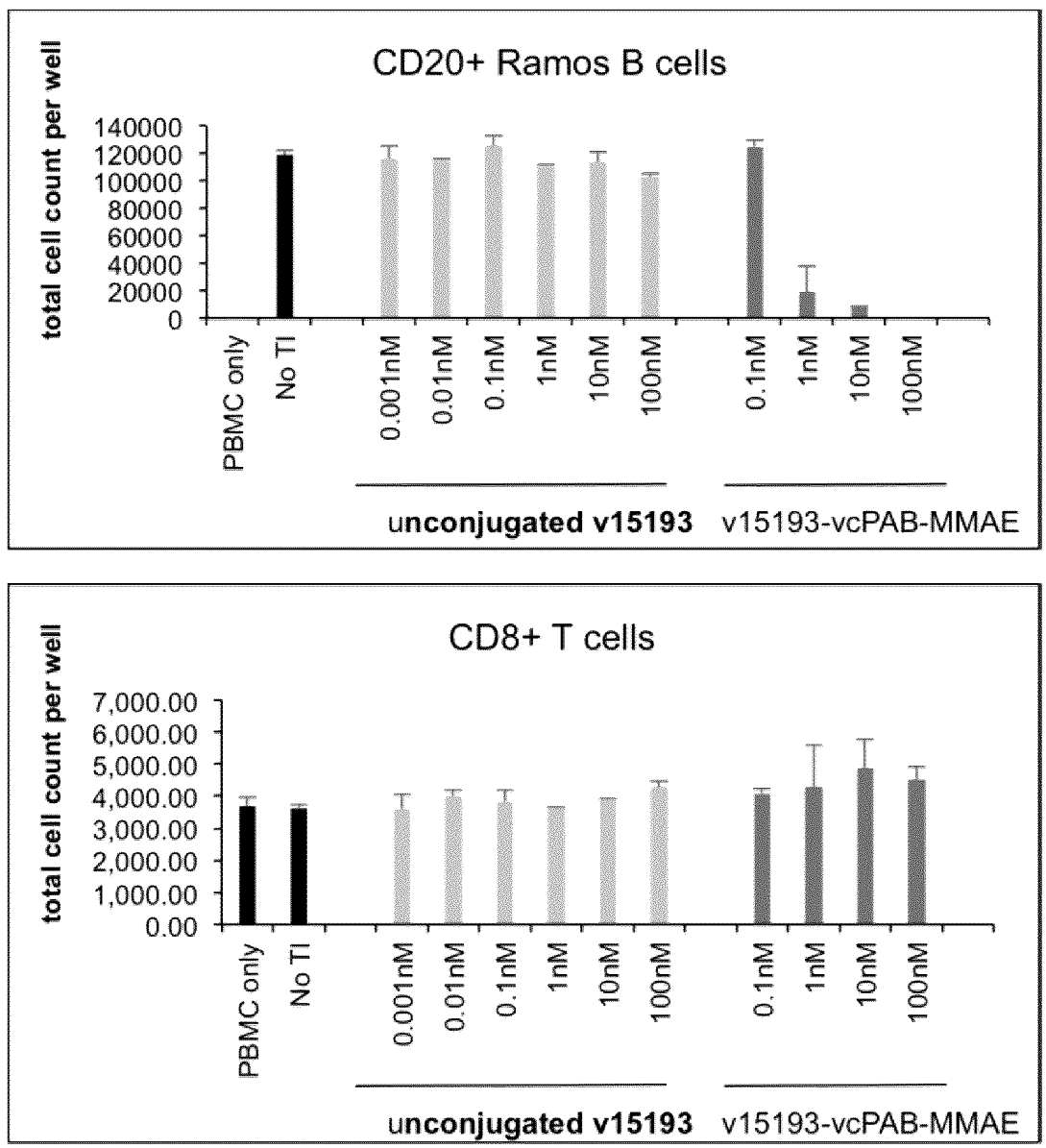
FIG. 21 depicts the effects of exemplary anti-CD3-CD19 antigen-binding construct v15193 and v15193 conjugated to MMAE at various concentrations on CD8+ T cells and target Ramos B cells in co-cultures with PBMC.

As illustrated in FIG. 21, comparison of the activity of the unconjugated and the MMAE conjugated bispecific variant (v15193 vs. v15193-mc-vc-PABC-MMAE ("v15193-vc-MMAE")) confirms that the cytotoxic activity of the anti-CD3-CD19 conjugate towards the allogeneic target B cells can be mediated by the T cell redirected activity of the bispecific, but also by the conjugated drug delivered by internalization of the antigen-binding construct by the target B cells.

mc-vc-PABC-MMAE:

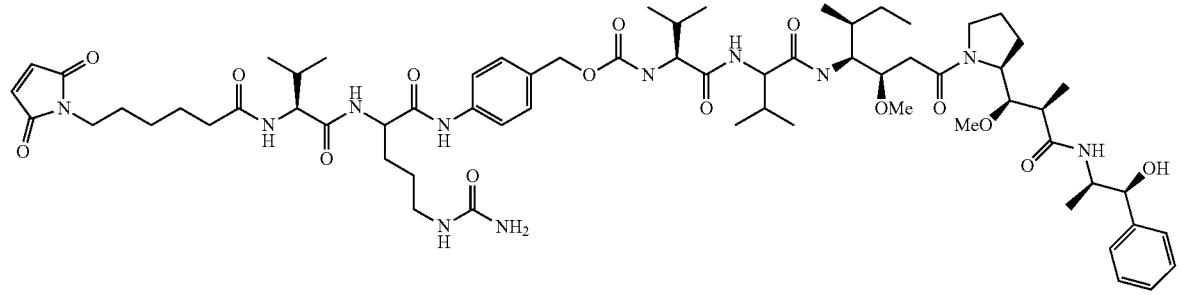

Further, the results show unexpectedly that v15193-mc-vc-PABC-MMAE had little to no effect on T cell counts suggesting that bispecific T cell engager drug conjugates can be developed both with non-cleavable linkers (as described above), and with cleavable linkers such as mc-Val-Cit-PABC.

Example 18. In Vivo Response to Exemplary Anti-CD3-CD19 Antigen-Binding Construct Drug-Conjugates in Humanized Hu(CD34+)NSG Mice To further evaluate the impact of anti-CD3-CD19 conjugates on the T cell population and activity, selected variants were analyzed in an in vivo study in humanized mice. The in vivo B cell depletion and activation and redistribution of autologous T cells was measured in humanized (CD34+) NSG mice (E:T~1:5) after a single dose IV injection of v12043 SMCC-DM1 and SPDB-DM4 conjugates in comparison to the non-conjugated v12043.

For humanization of mice, 2 week-old NSG (NOD scid gamma, NOD.Cg-Prkdcscid Il2rgtm1Wjl/SzJ) mice were injected with human (CD34+) HSC from human fetal liver (Jackson Laboratory. Humanized (CD34+) NSG mice develop human T cell and B cell linages within 12 weeks. Average T cell to B cell ratio in humanized (CD34+) NSG is ~1:5 to 1:1.

Humanized (hCD34+) NSG were dosed with 1 intravenous (IV) bolus injection at day 0 (at 0.3 and 0.1 mg/kg doses) and the autologous circulating B and T cell populations were analysed at 48 h post injection and at day 5 upon termination, similar to previously described (PCT/US2015/011664). The T cell and B cell populations were analyzed by FACS. The specific B and T cell markers analyzed were human CD45, CD20, CD4, CD8 and CD69, as described above in Example 10.

The in vivo serum exposure of the variants, as shown in Table 5, was estimated from previous data in NSG mice (see PCT/US2015/011664).

TABLE 10

| Estimated serum exposure for v12043 | |
|---|---|
| Serum conc. | 0.3 mg/kg |
| 0.5 h | >30 nM |
| 24 h | 10 nM |
| 48 h | 6 nM |
| 72 h | 3 nM |
| 120 h | 1 nM |

Figure 22:
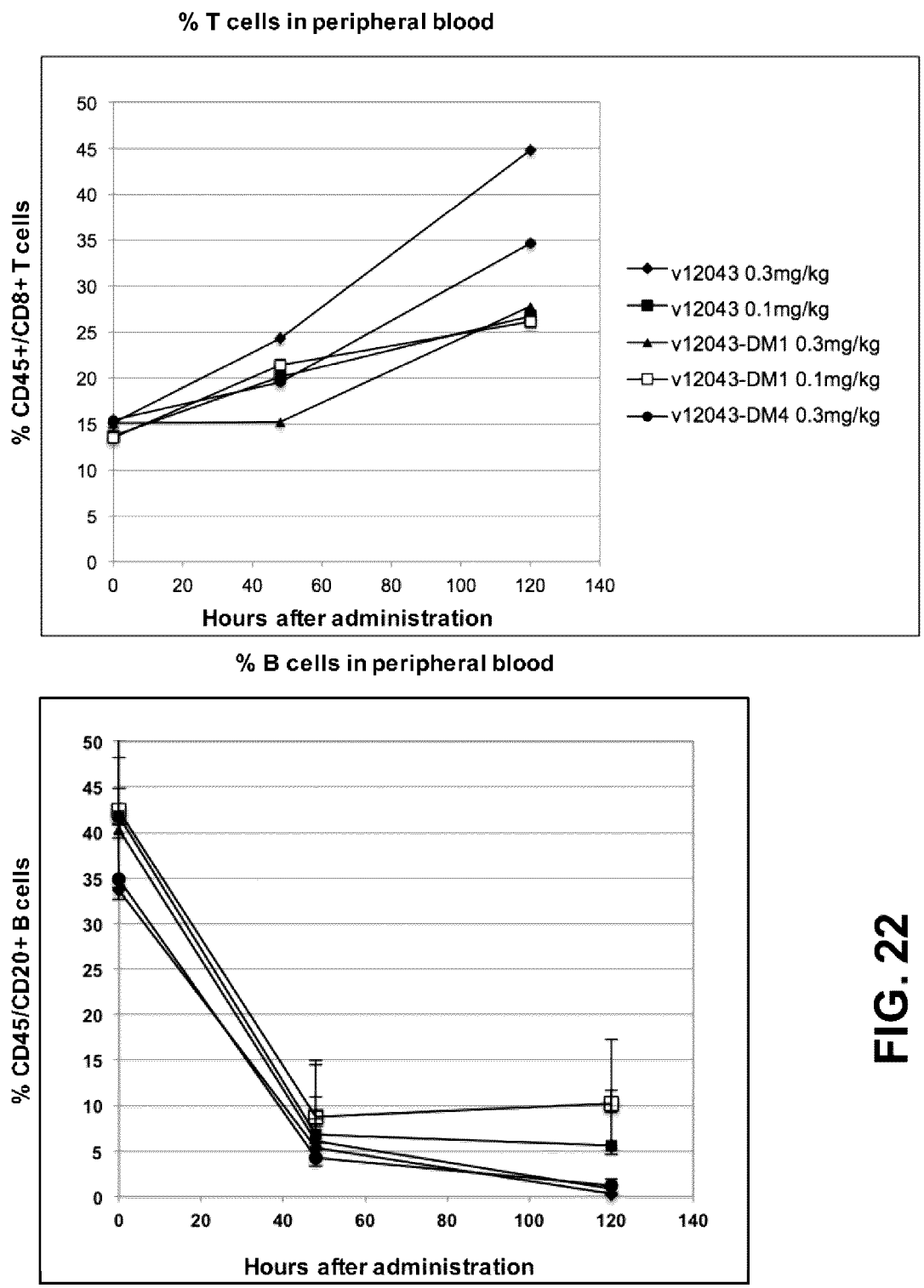
FIG. 22 depicts the effects of a single intravenous administration to humanized mice of varying doses ranging from 0.1 to 1.0 mg/kg of exemplary anti-CD3-CD19 antigen-binding construct v12043 (without drug conjugation), v12043-DM1 and v12043-DM4 on B and T cells counts in humanized NSG mice over a 5-day period after administration.

FIG. 22 shows the impact on the B and T cell counts in circulation after single dose injection of v12043 and the v12043 SMCC-DM1 and SPBD-DM4 conjugates. All variants and dose levels were effective in depletion the circulating B cells (CD20+ B cells) and no significant difference on T cell counts and T cell activation, as measured by CD69 expression on CD4 and CD8 positive T cells, was observed between the groups.

The estimation of the serum exposure in Table 10 suggests a Cmax of close to 50 nM, which was the maximum concentration used in the in vitro assay in primary blood cultures. The in vivo single dose study confirms that at even at the highest dose of 0.3 mg/kg and a Cmax close to 50 nM, the anti-CD3-CD19 conjugates have no negative impact on T cells. Further, the conjugates do not reduce the T cell activation and T cell redirected activity on the B cells.

Example 19. In Vivo Response of Anti-CD3-CD19 Antigen-Binding Construct Drug-Conjugates in Hu(CD34+)NSG Mice To further evaluate the impact of anti-CD3-CD19 conjugates on the T cells and T cell activation at higher doses and maximum exposures of over 300 nM, v15195-MCC-DM1 was analyzed in an in vivo study in humanized mice. The in vivo activation and redistribution of autologous T cells was measured in humanized (CD34+) NSG-SGM3 (NSG strain: NOD. Cg-Prkdc$^{scid}$ Il2rg$^{tm1Wjl}$ Tg(CMV-IL3,CSF2,KITLG) 1Eav/MloySzJ; Jackson laboratory) mice (E:T<1:5) after a single dose IV injection at 9 mg/kg, 3 mg/kg, 1 mg/kg, and 0.3 mg/kg. As control, a variant with only the anti-CD19 Fab connected to the heterodimeric Fc, but lacking the anti-CD3 scFv (v15760) was used. The monospecific anti-CD19 control variant v15760 was conjugated to SMCC-DM1 as described in Example 8, with a purity of >90% and DAR of 3.5.

Humanized (CD34+) mice present a good model system to evaluate human T cell activation, redistribution and expansion in a mouse model, whereas the proliferation and maturation of human B cells is partially deficient in these models (Ito et al., Cellular & Molecular Immunology 2012; 9: 208-214; Brehm et al., Curr Opin Endocrinol Diabetes Obes. 2010; 17(2): 120-125). We therefore don't expect to see a significant effect of the conjugated drug DM1 on the human B cells, whereas the human T cell activation and proliferation is well established in these models and the main aim of this study is to assess the impact of the anti-CD3-CD19 bispecific drug conjugate on the T cell activation and expansion.

The study was conducted as previously described in Example 18 and PCT/US2015/011664. Briefly, humanized (hCD34+) NSG-SGM3 mice were purchased from Jackson laboratory. The bispecific anti-CD3-CD19 ADC, v15195-MCC-DM1 was dosed with 1 intravenous (IV) bolus injection at day 0 (at 0.3, 1, 3 and 9 mg/kg doses) and the autologous circulating B and T cell populations in peripheral blood and isolated spleen were analysed at day 8 upon termination, similar to previously described (PCT/US2015/011664). The T cell and B cell populations were analyzed by FACS. The specific B and T cell markers analyzed were human CD45, CD20, CD4, CD8 and CD69, as described above in Example 10 and 18.

Figure 23:
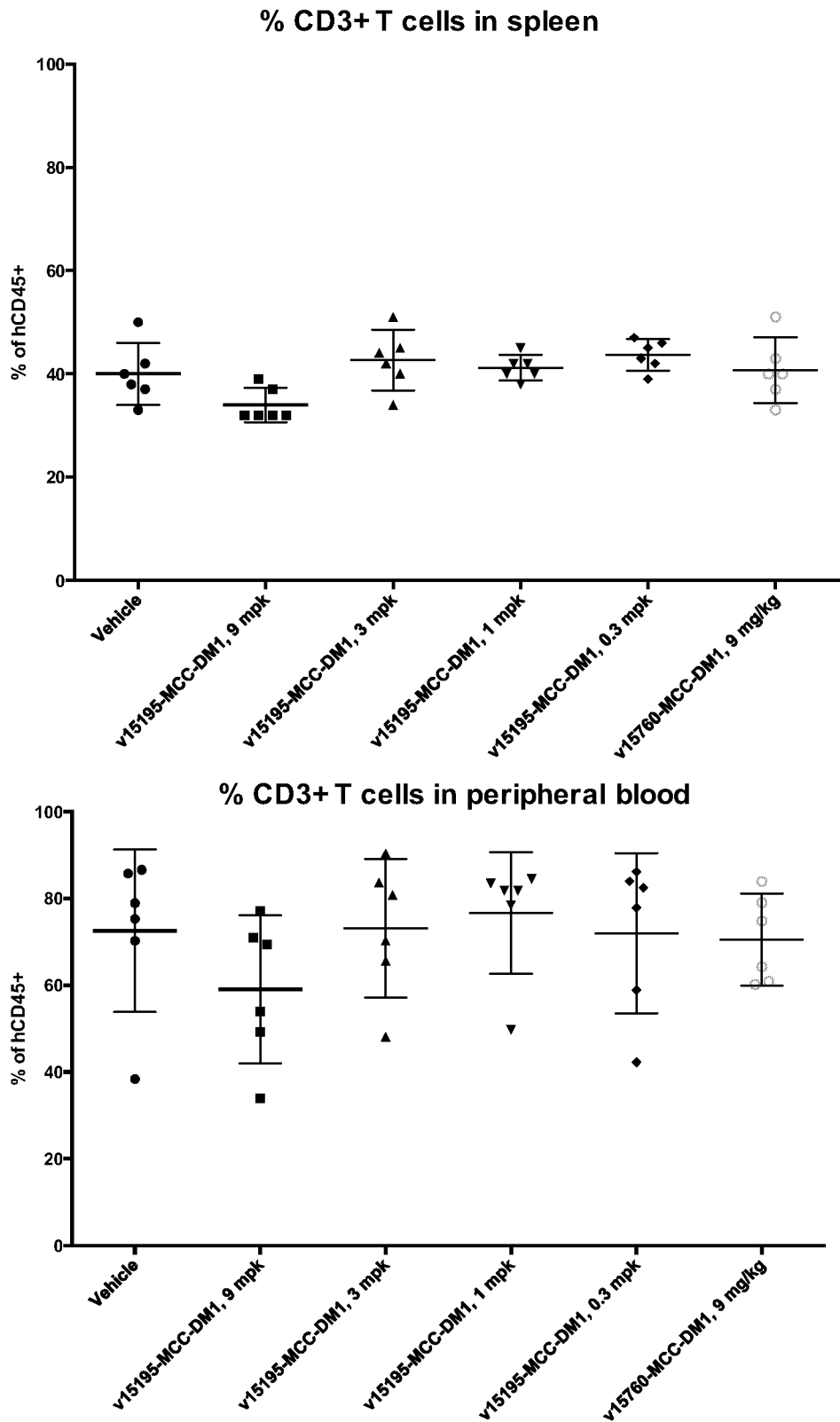
FIG. 23 depicts the effects of a single intravenous administration to humanized mice of varying doses ranging from 0.3 to 9.0 mg/kg of exemplary anti-CD3-CD19 antigen-binding construct v15195 conjugated to DM1 on CD3+ T cells in spleen and peripheral blood at 8 days after administration.

FIG. 23 shows the total CD3+ T cell counts in peripheral blood and isolated spleen at day 8 post injection of the single dose. The results show that only at the selected highest dose of 9 mg/kg a significant effect on the T cells in circulation and in the spleen was observed. No impact on T cell counts and activation was observed at 3 mg/kg and lower doses.

The in vivo serum exposure of v15195, as shown in Table 11, was estimated from previous data of the unconjugated variants in NSG mice (PCT/US2015/011664).

The estimated serum exposure in Table 11 suggests that the bispecific T cell engager—MCC-DM1 conjugates can be dosed up to at least 3 mg/kg and an associated Cmax of >300 nM, without long term impact on the autologous T cells. This is an exposure and Cmax similar to other SMCC-DM1 antibody frug conjugates in clinical development and thus allows the development of T cell engager drug conjugates at dose levels that are standard for other—MCC-DM1 ADCs in development (Jumbe at al., J Pharmacokinet Pharmacodyn (2010) 37:221-242; Lu et al., Cancer Chemother Pharmacol (2014) 74:399-410).

TABLE 11

| Estimated serum exposure | | | | |
|---|---|---|---|---|
| Serum conc. | 9 mg/kg | 3 mg/kg | 1 mg/kg | 0.3 mg/kg |
| 0.5 h | >900 nM | >300 nM | >30 nM | >30 nM |
| 24 h | 300 nM | 100 nM | 10 nM | 10 nM |

TABLE 11-continued

Estimated serum exposure

| Serum conc. | 9 mg/kg | 3 mg/kg | 1 mg/kg | 0.3 mg/kg |
|---|---|---|---|---|
| 48 h | 180 nM | 60 nM | 6 nM | 6 nM |
| 72 h | 90 nM | 30 nM | 3 nM | 3 nM |
| 120 h | 30 nM | 10 nM | 1 nM | 1 nM |

Example 20. Expression and Purification of Bi-Specific Anti-Tumor-CD3 Antigen-Binding Constructs for Solid Tumor Indications Bispecific antibodies against CD3 and CDH3, HER2, HER3 or EGFR were designed, expressed and characterized as described in PCT/US2015/011664. Briefly, the genes encoding the antibody heavy and light chains were constructed via gene synthesis using codons optimized for human/mammalian expression. The scFv-Fc sequences were generated from a known anti-CD3 scFv BiTE™ antibody (Kipriyanov et. al., 1998, Int. J Cancer: 77, 763-772) and anti-CD3 monoclonal antibody OKT3 (Drug Bank reference: DB00075). The CDH3 Fab sequences were generated from a known anti-CDH3 monoclonal antibody (PCT/JP2009/007333). The HER2 Fab sequences were generated from trastuzumab (PCT/US1998/026266, Baselga J et al., 1998, Cancer Res: 58, 2825-31) and the HER3 Fab sequences were generated from a known anti-HER3 monoclonal antibody (PCT/EP2010/070062, Mirschberger C, et al., 2013, Cancer Res: 73, 5183-94). EGFR sequences were generated from cetuximab (PCT/US1996/009847, Prewett M et al., 1996, J Immunother Emphasis Tumor Immunol: 19, 419-27). The Fab-scFv variants made are described in Table 12.

The humanized anti-CD3 OKT3 scFv was generated identical to anti-CD3 scFv of the murine OKT3 variants v875 or the humanized OKT3 variant v15195, described above. The anti-CD3 BiTEx-IC2 scFv was generated from the VH and VH sequences as described in (US 20110275787 A1), which is cross-reactive with non-chimpanzee primate CD3. The humanized OTK3 scFv or the BiTEx-IC2 scFv were fused to one chain of the heterodimeric Fc. The anti-CDH3 monoclonal, Clone #6 Fab is a chimeric Fab using the murine Clone #6 VH and VI. sequences fused to human IgG1 CH and CL sequences respectively. The anti-HER2 monoclonal Fab consists of the humanized VH and VL sequences of trastuzumab fused to human IgG1 CH and CL sequences, respectively. The Fab of the anti-HER3 monoclonal is a fusion of the humanized VH and VL sequences of lumretuzumab (PCT/EP2010/070062; Mirschberger C., et al., 2013, Cancer Res., 73:5183-94) to human IgG1 CH and CL sequences, respectively. The anti-EGFR monoclonal, cetuximab Fab is a chimeric Fab using the murine cetuximab VII and VL sequences fused to human IgG1 CH and CL sequences, respectively. In all cases, the VH-CH domains of the antibodies are fused to the second chain of the heterodimeric Fc.

TABLE 12

Summary of Variants and Composition

| Bispecific variant # | Anti-tumor antigen chain | Anti-CD3 chain |
|---|---|---|
| v13831 | αCDH3_Clone #6 Fab | BiTEx-I2C scFv (VL/VH) |
| v13792 | αHER2_(trastuzumab) Fab | BiTEx-I2C scFv (VL/VH) |
| v13790 | αHER3_Mab205 Fab | BiTEx-I2C scFv (VL/VH) |
| v16371 | αEGFR_(cetuximab) Fab | BiTEx-I2C scFv (VL/VH) |

All variants have the following CH3 mutations: Heavy chain A: T350V_L351Y_F405A_Y407V; Heavy chain B: T350V_T366L_K392L_T394W. Chain A or B can be either on the anti-CD3 or the anti-tumor antigen chain.

All variants have the following CH3 mutations: Heavy chain A: T350V_L351Y_F405A_Y407V; Heavy chain B: T350V_T366L_K392L_T394W. Chain A or B can be either on the anti-CD3 or the anti-tumor antigen chain.

Fc numbering is according to EU index as in Kabat referring to the numbering of the EU antibody (Edelman et al., 1969, Proc Natl Acad Sci USA 63:78-85); Fab or variable domain numbering is according to Kabat (Kabat and Wu, 1991; Kabat et al, Sequences of proteins of immunological interest. 5th Edition—US Department of Health and Human Services, NIH publication no. 91-3242, p 647 (1991)).

The clones that correspond to each bi-specific anti-tumor-CD3 and antigen-binding construct are shown in Table XX, and the corresponding sequence composition of each clone is shown in Table YY.

The bispecific antibodies against CD3 and CDH3, HER2, HER3 or EGFR were designed, expressed and characterized as described in PCT/US2015/011664 and in Examples 1 and 2.

The bispecific antibodies were purified by Protein A affinity chromatography and subsequent gel filtration, as described in Example 1.

Example 21. In Vitro Internalization of Bispecific Anti-Tumor-CD3 pHAb-Conjugates on Solid Tumor Cell Lines and Jurkat T Cell Line Conjugation of a pHAb dye to antibodies is a method used to assess internalization of a given antibody by a cell. The dyes only fluoresce under low pH conditions such as those found the the endosome/lysosome, indicating internalization of the antibody. Exemplary bispecific anti-tumor-CD3 antigen-binding construct pHAb conjugates were made as follows. Variants were conjugated to pHAb Amine Reactive Dye as per the manufacture's protocol for in-solution antibody conjugation (Promega).

The starting protein sample was first exchanged in 10 mM sodium bicarbonate buffer (pH 8.5) using a desalting column. A 10 mg/ml solution of pHAb Amine Reactive Dye dissolved in a 1:1 DMSO-water mix was then added at a 20 molar excess to the antibody sample. The reaction mixture was incubated for 60 minutes with mixing. Unreacted dye was removed using a desalting column. The antibody concentration and DAR were calculated after measuring absorbance at 280 nm and 532 nm. High performance liquid chromatography-size exclusion chromatography (HPLC-SEC) was performed to determine the purity of the conjugates, using the Superdex 200 column (8.6 μm, 5×150 mm), in D-PBS+0.01% Polysorbate 20, at a flow rate of 0.25 ml/min.

pHAb conjugates of v13831, v16371 had a yield of over 60%, a purity by HPLC-SEC of >90% and a drug/antibody ratio (DAR) of 1.5-3.3.

The extent of internalization was measured in several tumor cell lines, SKOV3 (ATCC: HTB 77), A431 (ATCC: CRL-1555), HCT-116 (ATCC: CCL-247) and JIMT1(AddexBio #C0006005), in comparison to non-specific IgG pHAb conjugate (v15195) and an anti-CD3 pHAb conjugated mAb, v2171 (UCHT1, Beverley P C and Callard R E., 1981, Eur J Immunol., 11: 329-34; PCT/US1993/007832). The anti-RSV antibody, Synagis (PCT/US1991/002668), was used as a negative control. The impact on T cells is tested on CD3+ Jurkat T cell. The selected antibodies were diluted in media and added to the target cells in triplicate and incubated for 1 hr. Cells were washed, media replaced and antibody internalization was evaluated using ImageExpress following standard procedures. Data was normalized to untreated control and analysis was performed in GraphPad prism.

Figure 24:
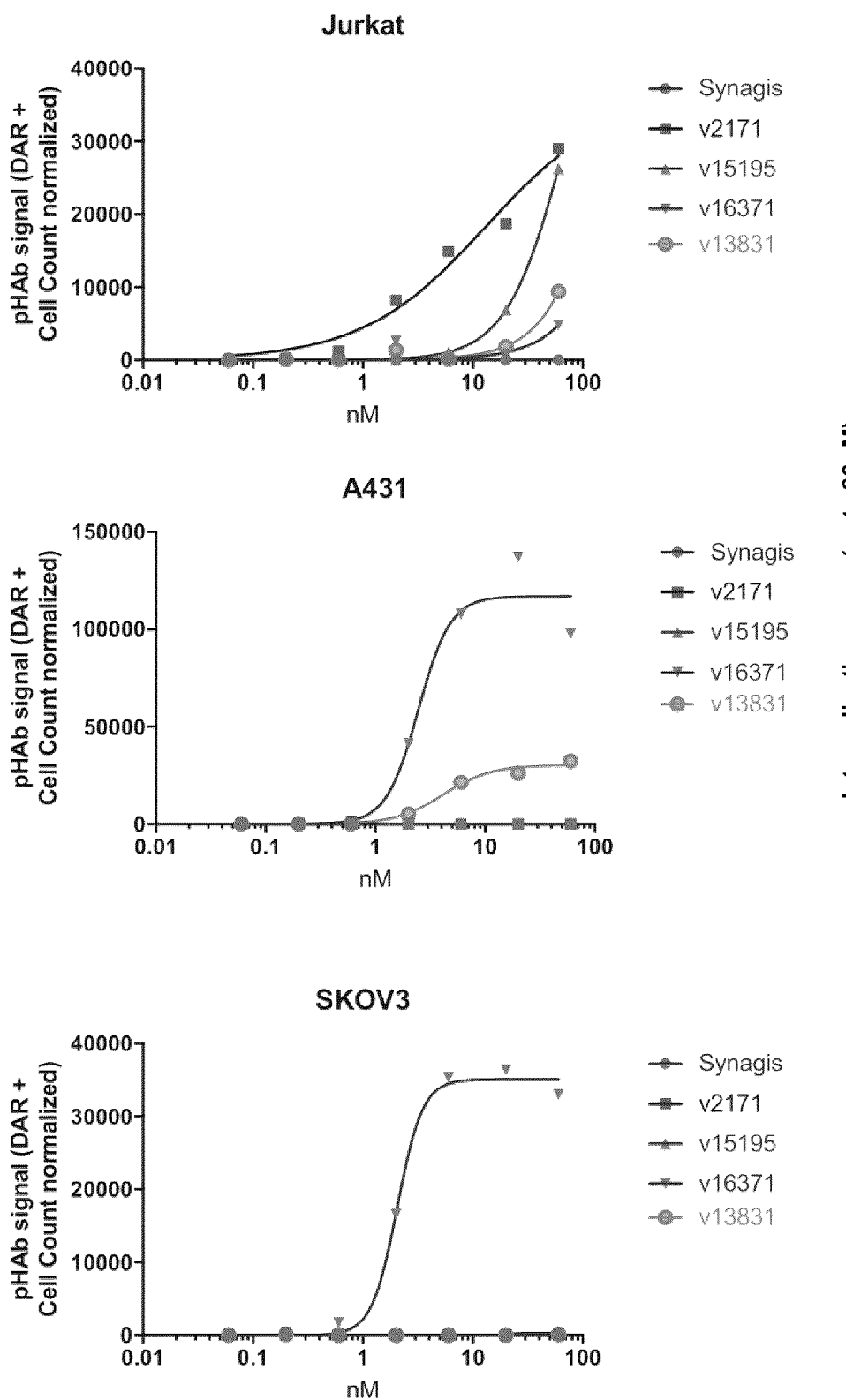
FIG. 24 depicts the internalization into cells of pHAb-labelled exemplary antigen-binding constructs anti-CD3-CD19 v15195, anti-CD3-EGFR v16371, and anti-CD3-CDH3 v13831 and control antibodies (v2171 UCHT1 anti-CD3 monospecific bivalent antibody; and anti-RSV antibody, Synagis). Cell lines tested were Jurkat, A431, SKOV3, HCT-116 and JIMT1.

The internalization results, as illustrated in FIG. 24 and Table 13 show that pHAb conjugated v13831 and v16371 are rapidly internalized by SKOV3, A431, HCT-116 and JIMT1 cells, with Kd values in the nM range and internalization of the variants is dependent upon expression of the target antigen. Unexpectedly, these variants are poorly internalized by the Jurkat T cell line. Furthermore, the bivalent anti-CD3 pHAb conjugated mAb (v2171, UCHT1) was internalized by Jurkat cells at close to 2 nM, while the bispecifics based on two different anti-CD3 scFvs, which target slightly different CD3e epitopes (OKT3 and xBiTE), showed low internalization into Jurkat T cells (72 nM and >100 nM, respectively).

Therefore, the data suggests that the bispecific tumor-CD3 antibodies are preferentially internalized by tumor cells compared to CD3+ cells making it less likely that ADC versions of these bispecifics would exhibit toxicity towards the T cells being engaged by the CD3 arm.

T cell engager ADCs, as described in Example 9, can be transferred to different tumor targets. In addition, the low impact on T cells is not specific to a particular epitope on CD3e, but likely rather dependent on the format and geometry of the bispecific, as described in Example 9.

Example 22. Cytotoxicity of Bispecific Anti-Tumor-CD3-SMCC-DM1 Drug Conjugates Against Breast, Ovarian Tumor Cell Lines Grown in Culture without T Cells To test the cytotoxicity and potency of the bispecific anti-tumor-CD3 variants, selected variants were conjugated to SMCC-DM1 as described in Example 8. All SMCC-DM1 conjugates of v13831, v13792 and v13790 had comparable yield of over 70%, purity of >90% and a drug/antibody ratio (DAR) of 3.1-3.5.

The extent of cytotoxicity was measured in cell cultures of different breast (MCF7 (ATCC: HTB-22) and JIMT1) and ovarian (SKOV3) tumor cell lines in comparison to non-specific IgG SMCC-DM1 conjugate (Isotype DM1). The impact on T cells is tested on CD3+ Jurkat T cells. The experiment was conducted as described in detail in Example 9.

Figure 25:
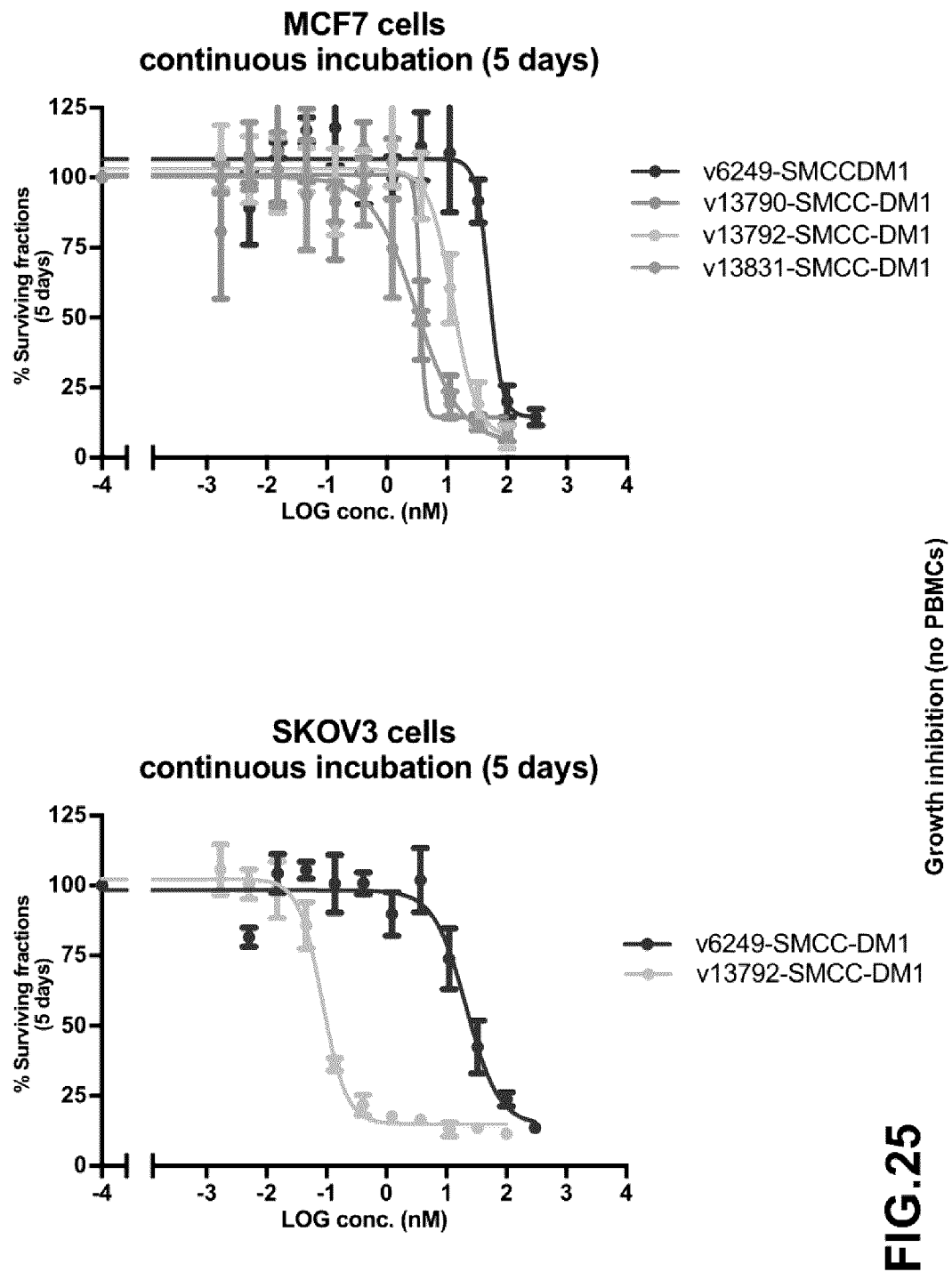
FIG. 25 depicts the direct cytotoxicity/growth inhibition in the absence of T cells on target cells lines by exemplary antigen-binding constructs anti-CD3-CDH3 v13831, anti-CD3-HER2 v13792, anti-CD3-HER3 v13790 all conjugated to DM1 in comparison to an non-specific IgG control v6249. Cell lines tested were MCF7, SKOV3, JIMT1 and Jurkat.

FIG. 25 illustrates the results for a selected subset of target cell lines and Table 14 summarizes the results in comparison to the IgG-DM1 control.

The results of the cytotoxicity study, as illustrated in FIG. 25 and Table 14 show that the DM1 conjugated variants, v13831, v13792, and v13790, exhibit potent killing of breast and ovarian tumor cell lines but do not significantly impact the growth of the Jurkat T cells. This preferential killing of

TABLE 13

Differential internalization of pHAb conjugated bispecific tumor-CD3 variants by tumor cell lines

| Target cell line | EC50 (nM) | | | |
|---|---|---|---|---|
| | v13831 bispecific (αCDH3-BiTEx) | v16371 bispecific (αEGFR-BiTEx) | v15195 bispecific (αCD19-hOKT3) | v2171 αCD3 control (hUCHT1) |
| Solid Tumor | | | | |
| HCT-116 (EGFR$^-$/CDH3$^+$) | 3.92 | >100 | | |
| A431(EGFR$^+$/CDH3$^+$) | 4.15 | 2.46 | | |
| JIMT1 (EGFR$^+$/CDH3$^+$) | <10* | 2.90 | | |
| SKOV3 (EGFR$^+$/CDH3$^-$) | >100 | 2.05 | | |
| T-cell leukemia | | | | |
| Jurkat (CD19$^-$, CD3$^+$) | >100 | >100 | 71.95 | 13.2 |

*Estimated EC50; accurate fitting of the parameters was not possible due to increased background levels at antibody concentrations greater than 100 nM (see FIG. 24 for comparison).

The results illustrate further, that the concept of a bispecific T cell engager ADC with dual functionality, as established in Examples 1-14 for CD19-CD3 bispecifics can be expanded to different solid tumor antigens and solid tumor targeting bispecific T cell engagers. The preferential tumor targeting without impacting the T cells is not specific to the CD19 antigen, and the concept for the design of bispecific tumor cell lines is similar to the preferential internalization of the variants by tumor cell lines presented in Example 22. The non-specific variant, v6249-SMCC-DM1, does not exhibit any significant killing of tumor cell lines or Jurkat T cells until concentrations greater than 100 nM are used. This highlights the role target specificity plays in the activity of the anti-tumor-CD3 bispecific antibodies.

TABLE 14

Cytotoxicity of SMCC-DM1 drug conjugates against breast,
ovarian tumor cell lines grown in culture without T cells

| | EC50 (nM) | | | |
|---|---|---|---|---|
| Target cell line | v13831-SMCC-DM1 (αCDH3-BiTEx) | v13792-SMCC-DM1 (αHER2-BiTEx) | v13790-SMCC-DM1 (αHER3-BiTEx) | v6249-SMCC-DM1 (hIgG) |
| Breast cancer | | | | |
| MCF7 | 3.1 | 12.6 | 3.6 | 50.2 |
| JIMT1 | 1.4 | 3.4 | — | 34.1 |
| Ovarian cancer | | | | |
| SKOV3 | — | 0.1 | — | 21.5 |
| T-cell leukemia (CD19⁻, CD3⁺) | | | | |
| Jurkat | 12.2 | 16.7 | 15.3 | 53.7 |

Therefore, the data suggests that, like the CD19-CD3 bispecifics, the bispecific anti-tumor-CD3 drug conjugates preferentially kill tumor cells compared to CD3+ cells. This further supports the conclusion that bispecific ADCs would possess potent anti-tumor activity while exhibiting little to no toxicity towards the T cells being engaged by the CD3 arm.

Example 23. Cytotoxicity of Unconjugated and SMCC-DM1 Conjugated Anti-Tumor-CD3 Bispecifics Against Tumor Cell Lines Grown in Culture with T Cells To further test the preferential killing of target tumor cells without effecting T cells and T cell activity, selected variants were tested in primary blood cultures with allogeneic JIMT1 cell line. The cytotoxic activity of the bispecific anti-CD3-tumor conjugates was measured in comparison to the non-conjugated anti-CD3-tumor variant. To measure the effect of the conjugates on the T cell population the T cell activity, activation and proliferation were further analyzed as described in Example 23. The assay was performed with n=1 primary blood donors and the experimental set-up was conducted as described above in Example 5 with minor modifications described below.

Specifically, on day 0 JIMT1 cells were first labeled with CellTracer violet (a live/dead stain). Following the labeling of the JIMT1 target cells, PBMCs were isolated for use as effector cells. Rested PBMCs were mixed with the labeled JIMT1 cells such that the ratio of T cells to allogeneic JIMT1 cells was adjusted to an E:T ratio of 2:1. The mixtures were incubated together with the antibody constructs for 4 days, after which the JIMT1 cells were collected and viability was assessed though FACS analysis of CTV levels. This was carried out by InCyte/FlowJo as follows: Between 5,000 event for FSC/SSC and compensation wells, and 30,000 events for experimental wells were analyzed by cytometry. A threshold was set to skip debris and RBCs.

Figure 26:
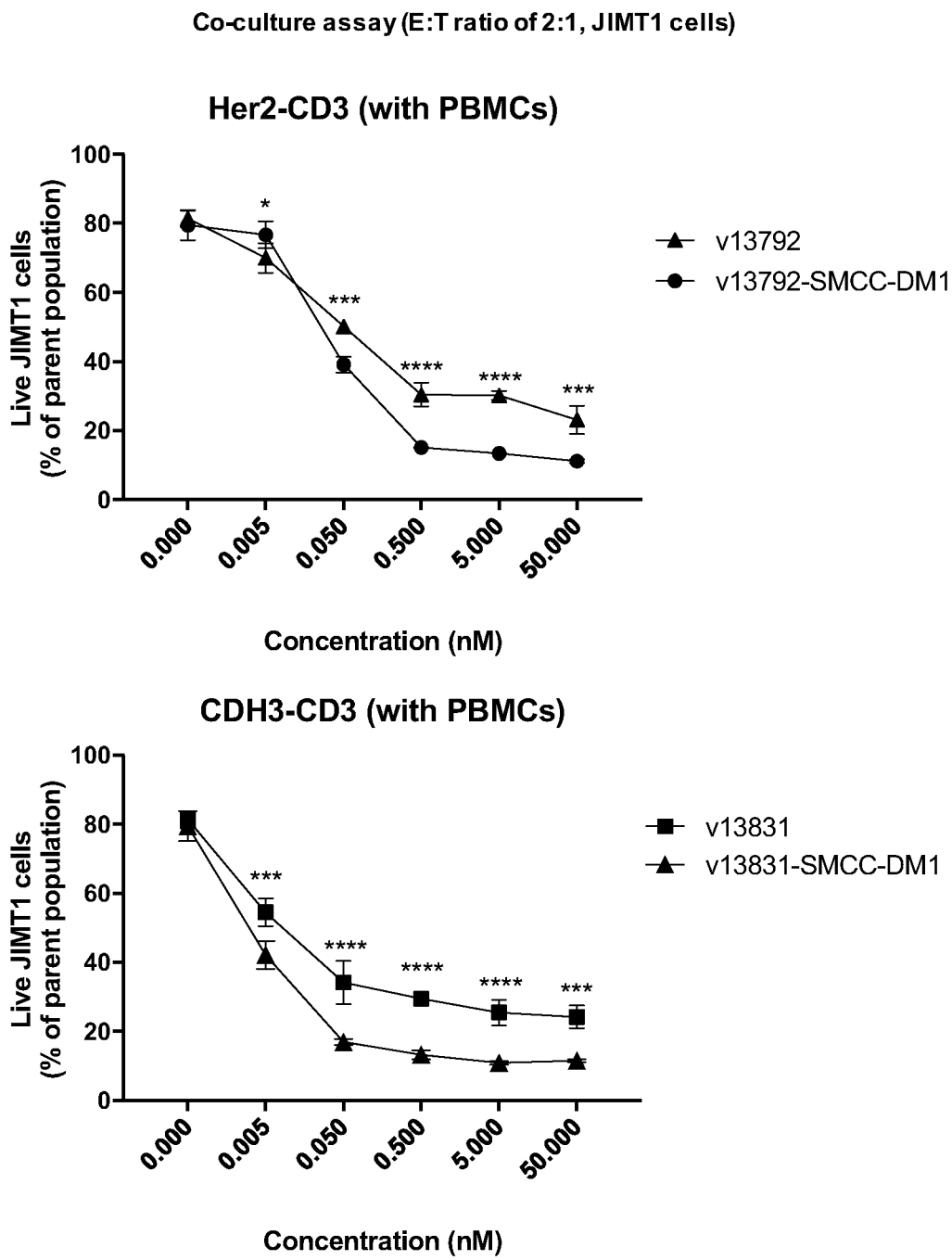
FIG. 26 depicts the effects of exemplary antigen-binding constructs anti-CD3-CDH3 v13831, and anti-CD3-HER2 v13792 and their DM1 conjugates at various concentrations on JIMT1 tumor target cells co-cultured with PBMCs.

As illustrated in FIG. 26, both the unconjugated and SMCC-DM1 conjugated forms of the variants, v13831 and v13792 exhibited potent cytotoxic activity towards JIMT1 cells. The results show that this cytotoxic activity towards the allogeneic target tumor cells can be mediated by the T cell redirected activity of the bispecific. Interestingly, SMCC-DM1 conjugation of variants v13831 and v13792 enhanced tumor cell killing compared to the unconjugated versions of these variants at concentrations greater than 0.05 nM. This is likely a result of drug delivery to the target tumor cells through internalization of the antigen-binding construct.

Further, the results show the benefit of a dual mechanism as the T cell mediated activity of the unconjugated variants is highly donor dependent and not sufficient to kill>90% of the target tumor cells in this assay.

Example 24. T Cell Proliferation and Activation of Bispecific Anti-Tumor-CD3-SMCC-DM1 Drug Conjugates Compared to Unconjugated Anti-Tumor-CD3 Bispecifics The ability of the SMCC-DM1 conjugated bispecifics, anti-CDH3-CD3 and anti-HER2-CD3, and their parent unconjugated constructs to induce T cell activation and proliferation was assessed as described below.

On Day 0, blood was collected from each of 4 donors and PBMCs were freshly isolated. Resting PBMC were used as effector cells and JIMT1 cells as target cells and the ratio of T cells to allogeneic JIMT1 cells was adjusted to an E:T ratio of 2:1. The mixtures were incubated together with the antibody constructs for 4 days, after which the collected primary cells were stained for CD4, CD8, CD69, and CD25. FACS analysis of the different populations was carried out by InCyte/FlowJo as follows: Between 5,000 event for FSC/SSC and compensation wells, and 30,000 events for experimental wells were analyzed by cytometry. A threshold was set to skip debris and RBCs.

Figure 27:
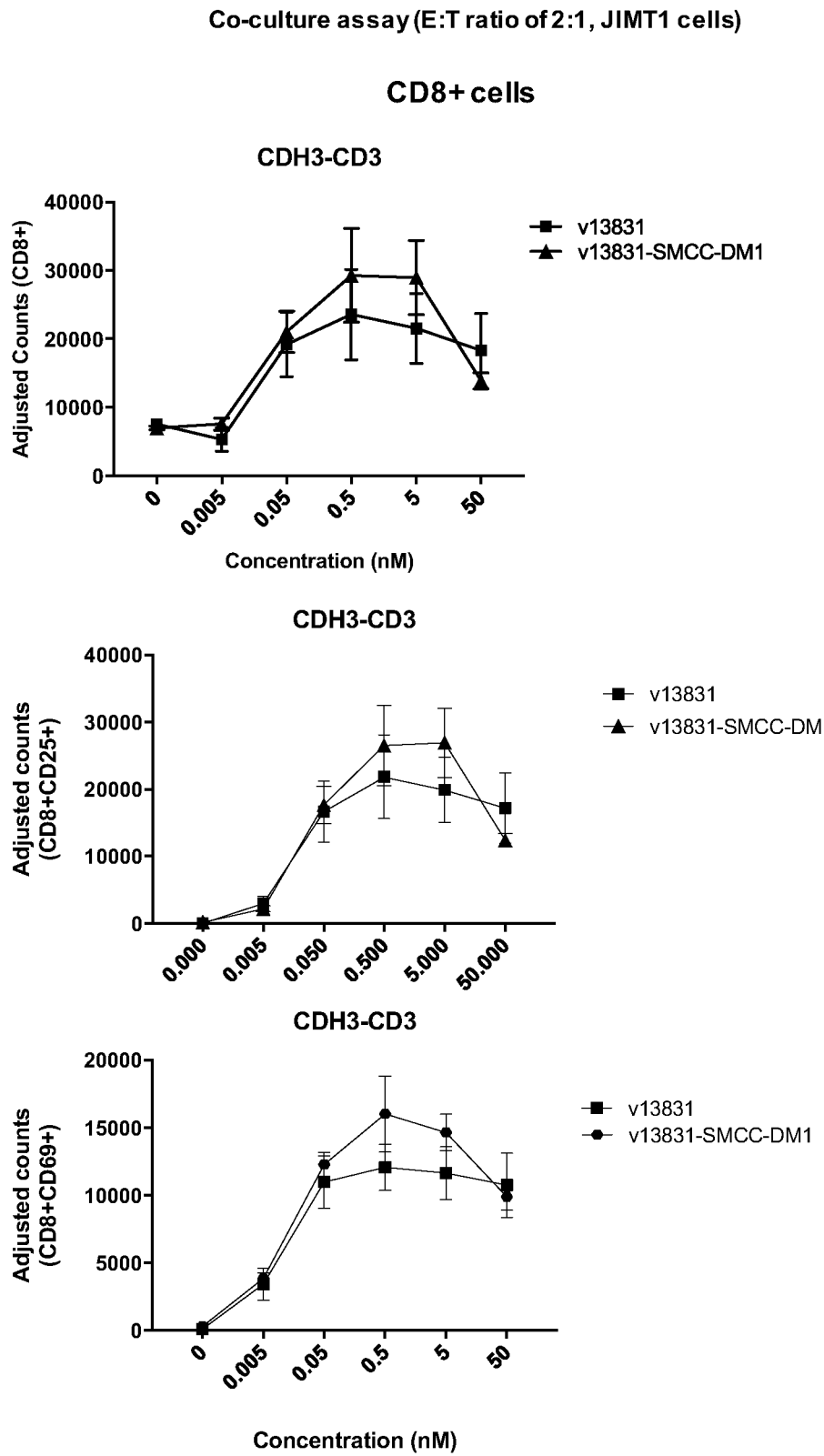
FIG. 27 depicts the T cell proliferation and activation of different T cell subpopulations in co-cultures of JIMT1 tumor target cells and PBMC to which various concentrations of DM1-conjugated or unconjugated anti-CD3-CDH3 v13831 or anti-CD3-HER2 v13792 were added. The level of CD4, CD4+CD69, CD4+CD25, CD8, CD8+CD69, CD8+CD25 positive T cells were evaluated for each construct.

The results of the FACS based analysis of T cell proliferation and activation in PBMC/JIMT1 co-cultures is shown in FIG. 27. The results illustrate that at efficacious concentrations, the SMCC-DM1 conjugated variants induce a modest increase in the total CD8+ and CD4+ T cell populations compared to the unconjugated parent variants. Total CD8+ and CD4+ T cell counts is an indirect measure of induced T cell proliferation suggesting that conjugation of a toxin to an anti-tumor-CD3 bispecific can enhance T cell proliferation induced by the unconjugated bispecific. Similarly, a modest increase in CD25+ and CD69+(early and late stage T cell activation markers, respectively) T cells is also observed in when the co-cultures are stimulated with the SMCC-DM1 conjugated variants compared to the unconjugated variants, suggesting increased activation of the T cells.

Example 25. T Cell Proliferation and Activation of Bispecific Anti-Tumor-CD3-SMCC-DM1 Drug Conjugates Compared to Unconjugated Anti-Tumor-CD3 Bispecifics-Range of High, Intermediate and Low Effector to Target Ratios To further delineate the role of each mechanism of action of the bispecific anti-tumor-CD3-SMCC-DM1 drug conjugates, T cell redirected killing and killing through internalization of the conjugated toxin payload, the cytotoxic activity of the anti-CD3-CDH3 conjugate, v13831-SMCC-DM1 was measured in comparison to its non-conjugated parent v13831. The variants were tested in primary blood cultures with allogeneic JIMT1 cell line at three different E:T ratios. The assay was performed with n=1 primary blood donors.

On day 0 JIMT1 cells were first labeled with CellTracer violet (a live/dead stain). Following the labeling of the JIMT1 target cells, PBMCs were isolated for use as effector cells. Rested PBMCs were mixed with the labeled JIMT1 cells such that the ratio of T cells to allogeneic JIMT1 cells was adjusted to an E:T ratios of 5:1, 1:5 and 1:50. The mixtures were incubated together with the antibody constructs for 4 days, after which the JIMT1 cells were collected and viability was assessed though FACS analysis of CTV levels. This was carried out by InCyte/FlowJo as follows: Between 5,000 event for FSC/SSC and compensation wells, and 30,000 events for experimental wells were analyzed by cytometry. A threshold was set to skip debris and RBCs.

Figure 28:
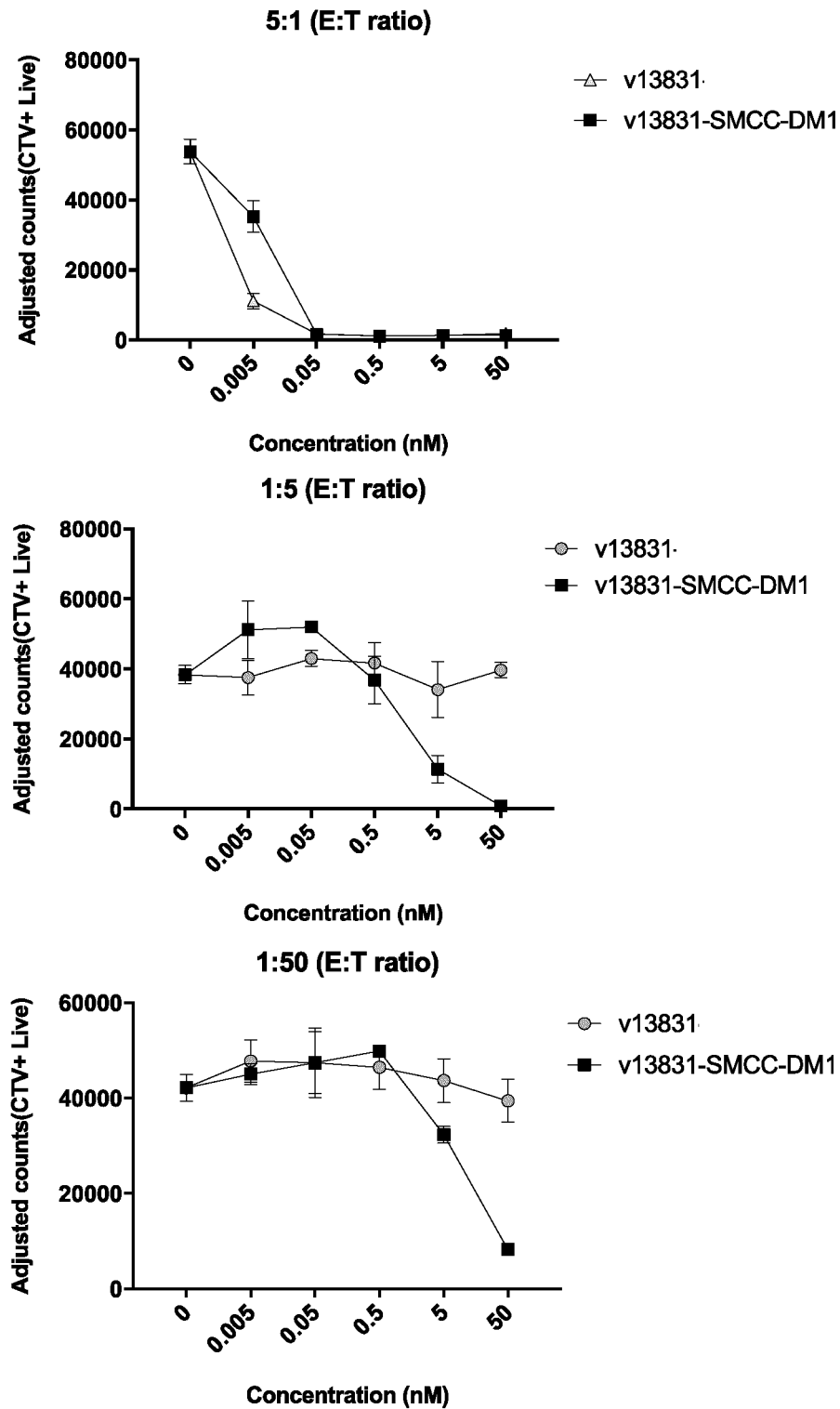
FIG. 28 depicts the effect of DM1-conjugated and unconjugated anti-CD3-CDH3 in co-cultures of JIMT tumor target cells and PBMC and different effector to target cell ratios.

The results presented in FIG. 28, suggest that at higher E:T ratios (eg. 5:1), the cytotoxic activity of the bispecific anti-CDH3-CD3 antibody, v13831 towards the allogeneic target tumor cells can be mediated by the T cell redirected activity of the bispecific. Thus, as the number of T effector cells decrease, as is the case in the 1:5 and 1:50 E:T ratios, tumor cell killing is nearly lost. Unlike the unconjugated variant, v13831-SMCC-DM1 was effective even at the lower E:T ratios (1:5 and 1:50) as a result of its second mode of action, drug delivery to the target tumor cells through internalization of the antigen-binding construct. Therefore, the data further supports the benefit of a dual mechanism of action as the T cell mediated activity of the unconjugated variants is highly donor dependent and not sufficient to kill>90% of the target tumor cells in this assay, especially when T effector cell concentrations are low. This may be of particular importance in indications where T cell infiltration of tumors is low.

TABLE XX

| Variant Number | H1 (Heavy Chain 1 Clone No.) | H2 (Heavy Chain 2 Clone No.) | L1 (Light Chain 1 Clone No.) | L3 (Light Chain 2 Clone No.) |
|---|---|---|---|---|
| 873 | 1064 | 1065 | | |
| 875 | 1064 | 1067 | | |
| 1661 | 2183 | 2176 | | |
| 1653 | 1842 | 2167 | | |
| 1662 | 2183 | 2177 | | |
| 1660 | 2174 | 2175 | | |
| 1666 | 2184 | 2185 | | |
| 1801 | 1842 | 2228 | | |
| 6747 | 5243 | 2227 | | |
| 10149 | 6692 | 6689 | | |
| 10150 | 6692 | 6690 | | |
| 1380 | 1844 | 1890 | | |
| 12043 | 7239 | 6689 | | |
| 1853 | 2304 | 2175 | | |
| 6754 | 5239 | 2185 | 2309 | |
| 10151 | 5239 | 6691 | 2309 | |
| 6750 | 5241 | 5238 | 2310 | |
| 6751 | 5242 | 2176 | 2310 | |
| 6475 | 2305 | 2171 | 2310 | |
| 6749 | 5242 | 2177 | 2310 | |
| 10152 | 5242 | 6689 | 2310 | |
| 10153 | 5242 | 6690 | 2310 | |
| 6476 | 2305 | 2170 | 2310 | |
| 6518 | 2304 | 2304 | 2309 | 2309 |
| 891 | 1109 | | | |
| 4372 | 3344 | 3345 | 3346 | 3346 |
| 15192 | 9288 | 9284 | 9289 | |
| 15193 | 9288 | 9285 | 9289 | |
| 15194 | 9288 | 9286 | 9289 | |
| 15195 | 9288 | 9287 | 9289 | |
| 17119 | 11176 | 11177 | 11175 | |
| 17118 | 11178 | 11179 | 11175 | |
| 13831 | 8074 | 3320 | 8071 | |
| 13792 | 1015 | 3320 | −2 | |
| 13790 | 3320 | 3299 | | |
| 16371 | 3537 | 3320 | 3357 | |
| 873 | 1064 | 1065 | | |
| 17119 | 11176 | 11177 | 11175 | |
| 17118 | 11178 | 11179 | 11175 | |

TABLE YY

| SEQ ID No. | Clone | Description | Sequence | |
|---|---|---|---|---|
| 1. | 2176 | Full | QIVLTQSPAIMSASPGEKVTMTCSASSSVSYMNWYQQKSGTSPKRWIYDTSKLASGVPAHRGSGSGTSYSLTISGMEAEDAATYYCQQWSSNPFTFGSGTKLEINGGGSGG GGSGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYDDHY CLDYWGQGTTLTVSSAAEPKSSDKTHTCPPCPAPEAAGGPSVFLFPPKPKDTLMISRTPEVTCVVVSSHEDPEVKFNWYVDGVEVHNAKTKPREEQYNSTYRVVSVLTVLHQD WLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSV MHEALHNHYTQKSLSLSPGK | -1 |
| 2. | 2176 | Full | CAGATCCTCCTGACACAGAGCCCAGCTATCATGTCAGCAAGTCCAGAGGGCAAGGTCACAATGACTTGCTCAGCCAGCTCCTCTGTGAGCTACATGAACTGGTATCAGCA GAAACGGAACCTCCCCCAGGAGATGGATCTACGACACATCCAAGCTGGCCTCTGGAGTGCCTGCTCACTTCAGGGGCAGCGGTCTGGGACCAGTTATTCACTGACA ATTTCCGGCATGGAGGCCGAAGATGCCGCTACCTACTATTGCCAGCAGTGGAGTTCAAACCCATTCACTTTTGGATCGGGGACTAAGCTGGAAATTAATGCGGAGGAG GCTCCGGAGGAGGAGGATCCGGAGGAGGAGGCTCAGCAGTCCAGGGCGCAGAGCTAGCTGCAGGACTGGCCCGTGGAGCTGGCCCGACCCGGAGCCGTGAAGATGTCCTGTAAGGC AAGCGGCTACACCTTTAAAGACAACAAGGCCACTCTGACAACAGATAAGAGCTCCTCAACAGCTTATATGGACTGAGTTCACTGACAGAGCTCTAGCGACAGTACAAACTAC CAGGTACTATGACGATCACTACTGTCTGATTATTGGGGCCAGGGACCAGTTGATGGAGTCACCGTCAGCAGTCCGAGCCTAAATCTAGTGACAAGACACATCCTGCCCCC CTTGTCCAGCCACCCAGAGGTCCACAGGAGGAGCCCAAAGAGGACCTTCCCCTGTTTCCCCCAAAACCAAAAGGATACTCTGATGATCTCCCGGACCCTGAGGTCACGTGCGTG AGCGTGTCTCACGAGGACCCTGTGCTCTGACGGCCGCCACGACGAGAGAGGGCCTACGGTGCTGCATGACGGGCTCAAGGTGGATGCAACGCGGAGGAGAACAGTACAACTCCACATATC TCCAAGCAATATTGCTGTGAGTGGGAATCCAATGGGCAGCCTGAGAACAACTACCTGACTTGGCCCTCTGACTGAGGGGCTTCTTTCTGTATAGTAAAC TGACCCTGACAGTCACGGTGGCAGCAGTCCCTTCAGTGTTCCGTGATCGATGAGGCATGAGGCGATGGTCTCACCTGGCTGCCTGTGCAGACTCCGGC AAG | -1 |
| 3. | 2176 | VL | QIVLTQSPAIMSASPGEKVTMTCSASSSVSYMNWYQQKSGTSPKRWIYDTSKLASGVPAHRGSGSGTSYSLTISGMEAEDAATYYCQQWSSNPFTFGSGTKLEIN | Q1-N106 |
| 4. | 2176 | VL | CAGATCCTCCTGACACAGAGCCCAGCTATCATGTCAGCAAGTCCAGAGGGCAAGGTCACAATGACTTGCTCAGCCAGCTCCTCTGTGAGCTACATGAACTGGTATCAGCA GAAACGGAACCTCCCCCAGGAGATGGATCTACGACACATCCAAGCTGGCCTCTGGAGTGCCTGCTCACTTCAGGGGCAGCGGTCTGGGACCAGTTATTCACTGACA ATTTCCGGCATGGAGGCCGAAGATGCCGCTACCTACTATTGCCAGCAGTGGAGTTCAAACCCATTCACTTTTGGATCTGGGACCAAGCTGGAAATTAAT | -1 |
| 5. | 2176 | L1 | SSVSY | S27-Y31 |
| 6. | 2176 | L1 | TCCTCTGTGAGCTAC | -1 |
| 7. | 2176 | L3 | QQWSSNPFT | Q88-T96 |
| 8. | 2176 | L3 | CAGCAGTGGAGTTCAAACCCATTCACT | -1 |
| 9. | 2176 | L2 | DTS | D49-S51 |
| 10. | 2176 | L2 | GACACATCC | -1 |
| 11. | 2176 | VH | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYDDHYCLDYWGQ GTTLTVSS | Q122-S240 |
| 12. | 2176 | VH | CAGGTGCAGCTGCAGCAGTCCGGAGCAGAGCTGGCTCGACCAGGAGCTAGTGTGAAAATGTCCTGTAAGGCAAGCGGCTACACCTTCACGCGGTATACCATGCATTGG GTGAAACAGAGACCTGGACAGGGACTGGAATGGATCGGGTACATTAATCCTTCAGCCGGTTACACAAACTACAACCAGAAGTTTAAGACAAGGCCACTCTGACCACA GATAAGAGCTCCTCTACCGCTTATATGCAGCTGAGTTCACTGACATCTGAGGACAGTGCAGTGTACTATTGCGCCAGGTACTATGACGATCACTACTGTCTGGATTATTGG GGCCAGGGGACTACCCTGACAGTGAGCTCC | -1 |

TABLE YY-continued

| SEQ ID NO. | Clone | Description | Sequence | |
|---|---|---|---|---|
| 13. | 2176 | H1 | GYTFTRYT | G147-T154 |
| 14. | 2176 | H1 | GGCTACACCTTCACACGGTATACC | -1 |
| 15. | 2176 | H3 | ARYYDDHYCLDY | A218-Y229 |
| 16. | 2176 | H3 | GCCAGGTACTATGACCATCACTACTGTCTGGATTAT | -1 |
| 17. | 2176 | H2 | INPSRGYT | I172-T179 |
| 18. | 2176 | H2 | ATTAATCCTAGCCGAGGATACACA | -1 |
| 19. | 2176 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A258-K367 |
| 20. | 2176 | CH2 | GCACCAGAGGCTGCAGGAGGACCTTCCGGTGTTCCTGTTTCCACCCAAACCAAAGGATACTCTGATGATCTCTGAGACCTGAAGTCACTTGCGTGGTGTCTGAGCGTGTCTCACGAGGACCCCGAAGTCAAGTTTAACTGGTACGTGGACGGCGTCGAGGTGCATAATGCCAAAACCAAGCCCAGGGAGGAGCAGTACAACTCCACATATCGCGTCGTCTCCGTCCTGACTGTGCTGCACCAGGATTGGCTGAATGGCAAGGAGTACAAATGCAAGGTGTCCAATAAGGCACTGCCCGCCCCCATCGAGAAGACAATTAGCAAAGCAAAG | -1 |
| 21. | 2176 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G368-G473 |
| 22. | 2176 | CH3 | GGGCAGCCCCGAGAACCTCAGTGCTACGTGCTGCCTCCAATCTCGGGACGAGCTGACTAAAAACCAGGTCAGTCTGCTGTGCCTGGTGAAGGGCTTCTATCCAAGCGATATTGCTGTGGAGTGGGAATCCAATGGGCAGCCAGGGAGAACATTACCTGGCCTGCAGATGGGAGCTTCTTTCTGTATAGTAAACTGACCGTGGACAAGTCACGGTGGCAGCAGGGAAACGTCTTTAGCTGTTCCGTGATGCATGAGGCCCTGCACAATCATTACACCCAGAAATCTCGAGTCTGTCTCACCCGGC | -1 |
| 23. | 2177 | Full | QIVLTQSPAIMSASPGEKVTMTCSASSSVSYMNWYQQKSGTSPKRWIYDTSKLASGVPAHRGSGSGTSYSLTISGMEAEDAATYYCQQWSSNPFTFGSGTKLEINGGGSGGGGSGGGGSQVQLQQSGAELARPGASVKMSCKASGYTFTRYTMHWVKQRPGQGLEWIGYINPSRGYTNYNQKFKDKATLTTDK5SSTAYMQLSSLTSEDSAVYYCARYYDDHYSLDYWGQGTTLTVSSAAEPKSSDKTHTCPPCPAPEAAGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK | -1 |
| 24. | 2177 | Full | CAGATCGTCCTGACACAGAGCCCAGCTATCATGTCAGCCAGCCCCGGCGAGAAAGTCACAATGACTTGCTCCTCTGTGAGCTACATGAACTGGTATCAGCAGAAAAGCGGAACCTCCCCCAAGAGATGGATCTACGACACATCTAAGCTGGCTTCAGGGGTCCCAGCGCGTCACTTCAGGGGGCAGCGGTCTGGCACCAGCTGGAGTTCAAACCATCTCACTTTTGGATCTGGACTGGAAATTAATGCCGGAGGAGGCTCCGGAGGAGGAGGAAGTCAGGTGCAGCTGCAGCAGAGCGGAGCAGAGCTAGTGCAAATGTCCTGTAAGGCAAGCGGCTACACCTTCACACGGTACACCATGCATTGGGTAAAGCAGCGGCCAGGACAGGGACTGGAATGGATCGGGTACATTAATCCTTCCGAGGATACAACTACAACCAGAAGTTTAAAGACAAGGCCACTCTGACCACAGATAAGAGCTCCTCAACGCTTATGCAGCTGAGCTCCCTGACCAGCGAGGATAGTGCAGTGTACTATTGCGCCCGGTACTATGACGATCACTACTCCCTGGATTATTGGGGCCAGGGAACCACACTAGTCACTGTCTCCAGCGCAGCACCAAAGAGTAGTGACAAGACCCATACCTGCCCCCCTTGTCCAGCACCAGAGGCTGCAGGACCTAGCGTGTTCCTGTTTCCACCCAAAACCAAGGATACTCTGATGATCTCCAGGACACCTGAAGTCACTTGTGTCGTGAGCGTGTCTCACGAGGACCCCGAAGTCAAGTTTAACTGGTACGTGGACGGCGTCGAGGTGCATAATGCCAAAACCAAGCCCAGGGAGGAACAGTACAACTCAACTATC | -1 |

TABLE YY-continued

| SEQ ID No. | Clone | Description | Sequence | |
|---|---|---|---|---|
| 25. | 2177 | VL | GCGTCGTCTGTCTGTCCTGACTGTGCTGCTCCACCAGGATTGGCTGAAGCGGCAAGGAGTACAAATGCAAGGTGAGCAACAGGCACTGCCTGCCTGCCCCAATGAGAGACAATTA GCAAAGCAAAGGGGCAGCCCGAGAACTCAGGTCCTACGTGCTGCTGCTCTCCGGGACGTCCATCTCGGACGAGCTGACTAAAAACCAGGTCAGTCTGCTGCTCTGGAAGGCTTCTA TCCAAGCAGGATATTGCTGTGGAGTGGGAATCCAATGGGAAGGCCCGAAAAACAATTACGACTTGGCCGTCGACTCCTCCTCTGACTCAGATGGGAGCTTCTTTCTGTATAGTAAAC TGACCGTGGACAAGTCACGGTGGCAGCGGCAGGGAAGTCTTTAGCTGTTCCGTGATGCATGGAGCCCTGACAATCATTACCAGGAAATCTCGAGTCTGTCACCCGGC AAG | Q1-N106 |
| 26. | 2177 | VL | QIVLTQSPAIMSASPGEKVTMTCSASSSVSTMNWYQQKSGTSPKRWIYDTSKLASGVPAHRGSGSGTSYSLTISGMEAEDAATYYCQQWSSNPFTFGSGTKLEIN | -1 |
| 27. | 2177 | L1 | SSVSY | S27-Y31 |
| 28. | 2177 | L1 | TCCTCTGTGAGCTAC | -1 |
| 29. | 2177 | L3 | QQWSSNPFT | Q88-T96 |
| 30. | 2177 | L3 | CAGCAGTGGAGTTCAAACCCATTCACT | -1 |
| 31. | 2177 | L2 | DTS | D49-S51 |
| 32. | 2177 | L2 | GACACATCC | -1 |
| 33. | 2177 | VH | QVQLQQSGAELARPGASVKMSCKASGYTFTRYTMHWVKQRPGQGLEWIGYINPSRGYTNYNQKFKDKATLTTDKSSSTAYMQLSLTSEDSAVYYCARYDDHYSLDYWGQ GTTLTVSS | Q122-S240 |
| 34. | 2177 | VH | CAGGTGCAGCTGCAGCAGAGCGGAGCGAGACTGGCTCGACCAGGAGCTGGAATGGAGCCCGGGCAGCAGAGCCGCAGCCAAGGCCTACACCTTCACGCGGTATACCATGCATTGG GTGAAACAGAGACCCGGGCAGGGACTGGAATGGATCGGGTACATTAATCCTTCCGAGGATACACAAGAAGTTTAAAGACAAACTACAACCAGAAGTTCCGAGGATCAAACAAGATGTCCTGTAAGGCAAGCCTACACCTTCACGCGGTATACCATGCATTGG GATAAGAGCTCCTCTACCGCTTATATGCAGCTGAGTTCACTGAGCTGAGGACAGTCAGTGTACTATTGCGCCAGGTACTATGACGATCACTACTCCCTGGATTATTGG GGCCAGGGGGACTACCCTGACAGTGAGCTCC | -1 |
| 35. | 2177 | H1 | GYTFTRYT | G147-T154 |
| 36. | 2177 | H1 | GGCTACACCTTCACACGGTATACC | -1 |
| 37. | 2177 | H3 | ARYYDDHYSLDY | A218-Y229 |
| 38. | 2177 | H3 | GCCAGGTACTATGACGATCACTACTCCCTGGATTAT | -1 |
| 39. | 2177 | H2 | INPSRGYT | I172-T179 |
| 40. | 2177 | H2 | ATTAATCCTTCCCGAGGATACACA | -1 |
| 41. | 2177 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A258-K367 |

TABLE YY-continued

| SEQ ID No. | Clone | Description | Sequence | |
|---|---|---|---|---|
| 42. | 2177 | CH2 | GCACCAGAGGCTGCAGGAGGACCTAGCGTGTTCCTGTTCCACCCAAACCAAAGGATACTTGATGATCTCCGACACCTGAAGTCACTTGTGTCGTGAGCGTGTCTCAGGAGGACCCCGAAGTCAAGTTTAACTGGCTACGTGGACGGCGTCGAGGTGCATAATGCCAAAACCAAGCCGGAGGAACAGTACAACTCCACATATCGCTGTGTCGTGTCCGTGCTGCACCAGGATTGGCTGAACGGCAAGGAGTACAAGTGCAAGGTCTCCAACAAAGCACTGCCCGCCCATCGAGAAGACAATTAGCAAAGCAAAG | -1 |
| 43. | 2177 | CH3 | GQPREPQVYVLPPSRDELTKNQVSLLCLVKGFYPSDIAVEWESNGQPENNYLLTWPVLDSDGSFFLYSKLTVDKSRMQQGNVFSCSVMHEALHNHYTQKSLSLSPG | G368-G473 |
| 44. | 2177 | CH3 | GGGCAGCCCCGAGAACCTACAGCTCTCAGGTCTGCCTGCCTCCATCCTGGGACGAGCTGACTAAAAACCAGGTCAGTCTGCTCTGTGTGAAGGGCTTCTATCCAAGGCGATATTGCTGTGGAGTGGAGAATCCAATGGGCAGCCCGAAAACAATTACCTGACCTGGCCCGTGCTGGACTCCGATGGAAGCTTCTTTCTGTATAGTAAACTGACCGTGGACAAGTCACGCTGGCAGCAGGGGAAACGTCTTTAGCTGTTCCGTGATGCATGAGGCCCTGCACAATCATTACACCCAGAAATCTCTGAGTCTGTCACCCGGC | -1 |
| 45. | 2177 | Full | DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | -1 |
| 46. | 2177 | Full | GATATTCAGATGACCCAGAGCCCCAAGCTCCCTCAGTGCCTCAGTGGCGACCGAGTCACCATCACATGCTCCGCTTCAGCGGCTCCAGATTCAAAGGTTGGATCTACGATACCAGCAAGCTGGCCTCTGGGGTCCCATCAAGGTTCAGCGGCAGTGGATCTGGGACAGATTACACCTTTACTATTTCAGCCTGCAGCCTGAGGATTTCGCTACATATTACTGTCAGCAGTGGTCTAGTAATCCATTCACTTTTGGCCAGGGACCAAGGCTGGAGATCAAAAGAACTGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT | -1 |
| 47. | 2309 | VL | DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQIT | D1-T106 |
| 48. | 2309 | VL | GATATTCAGATGACCCAGAGCCCCAAGCTCCCTCAGTGCCTCAGTGGCGACCGAGTCACCATCACATGCTCCGCTTCAGCGGCTCCAGATTCAAAGGTTGGATCTACGATACCAGCAAGCTGGCCTCTGGGGTCCCATCAAGGTTCAGCGGCAGTGGATCTGGGACAGATTACACCTTTACCATCAGCTCCCTGCAGCCCGAGGACATTGCCACCTATTACTGCCAGCAGTGGTCTAGTAATCCATTCACTTTTGGCCAGGGACCACAGGCTGGAGATCACA | -1 |
| 49. | 2309 | L1 | SSVSY | S27-Y31 |
| 50. | 2309 | L1 | AGTTCAGTGTCTTAC | -1 |
| 51. | 2309 | L3 | QQWSSNPFT | Q88-T96 |
| 52. | 2309 | L3 | CAGCAGTGGTCTAGTAATCCATTCACT | -1 |
| 53. | 2309 | L2 | DTS | D49-S51 |
| 54. | 2309 | L2 | GATACCTCA | -1 |
| 55. | 2309 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R107-C213 |
| 56. | 2309 | CL | AGGACTGTGGCCGCTCCCAGCGTCTTCATTTTCCCGCCATCTGATGAGCAGTTGAAATCTGGAACTGCCTCTGTTGTGTGCCTGCTGAATAACTTCTACCCTCGCGAAGCAAAGGTGCAGTGGAAGTGGATAACGCCCTGCAATCGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTATGCATGCGAAGTCACCCATCAGGGCCTGAGCTCGCCCGTCACAAAGAGCTTCAACAGGGGAGAGTGT | -1 |

TABLE YY-continued

| SEQ ID No. | Clone | Description | sequence | |
|---|---|---|---|---|
| 57. | 2310 | Full | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | -1 |
| 58. | 2310 | Full | GATATTCAGCTGACTCAGTCACCCGCTAGCCTGGCAGTGAGTCTGGGACAGAGGGCCACCATCAGCTGCAAGGCTTCACAGAGCGTTGACTACGATGGCGACAGTTACCTGAACTGGTATCAGCAGATCCCAGGCCAGCCCCTAAATCTGCTGATCTACGACGCTTCTAATCTGGTTAGCGGCATTCCTCCGGTCTTCCGGAGTGGAACTGATTTTACCCTGAACATTCACCCGGTGGAGAAGGTCGACGCCGCTACATACCATTGCCAGCAGAGTACAGAGGACCCGTGGACTTTCGGCGGGAACAAGCTGGAAATCAAACGGACAGTGGCAGCCCCATCCGTCTTCATTTTTCCTCCATCTGACGAGCAGCTGAAATCTGGAACAGCGGTGACAGCAGTGTGTGCCTGCTGAACAATTTTTACCCTGAGCGCCACCCTAAGCAAGGTCCAAAGCTGAAATCTGGAAAGTTCACAGAGCAGCACAAGTGTGTGGTCTCGTCGTCTAGCACACTGACACTGAGCAAAGCAGACTATGAGAAACATAAAGTGTATGCCTGCGAAGTTACCCATCAGGGACTGTCTAGTCCCGTGACAAAGTCTTTCAATCGAGGCGAATGT | -1 |
| 59. | 2310 | VL | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGGGTKLEIK | D1-K111 |
| 60. | 2310 | VL | GATATTCAGCTGACTCAGTCAGCCCCGTCAGCCTGGCAGTGAGTCTGGGCCAGAGGGCCACCATCAGCTGCAAGGCTTCACAGAGCGTTGACTACGATGGCGACAGTTACCTGAACTGGTATCAGCAGATCCCAGGACAGCCCCCTAAACTGCTGATCTACGACGCCTCTAATCTGGTGAGTGGCATCCCTCCGTCTGGCAGTGGAAGTGGAACTGATTTTACCCTGAACATTCACCCGGTGGAGAAGGTCGACGCTACATACCATTGCCAGCAGTCCACAGAGGACCCCTGGACTTTCGGCGGGAACAAGCTGGAAATCAAA | -1 |
| 61. | 2310 | L1 | QSVDYDGDSY | 027-Y36 |
| 62. | 2310 | L1 | CAGAGCGTCGACTACGATGGCGACAGCTAC | -1 |
| 63. | 2310 | L3 | QQSTEDPWT | Q93-T101 |
| 64. | 2310 | L3 | CAGCAGTCCACAGAGGACCCCTGGACT | -1 |
| 65. | 2310 | L2 | DAS | D54-S56 |
| 66. | 2310 | L2 | GACGCCTCT | -1 |
| 67. | 2310 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R112-C218 |
| 68. | 2310 | CL | CGGACAGTGGCAGCCCCATCCGTCTTCATTTTTCCTCCATCTGACGAGCAGCTGAAATCTGGAACAGCGGTGACAGCAGTGTGTGCCTGCTGAACAATTTTTACCCTGAGCGCCACCCTGACACTGTCCAAAGCTGAAATCTGGAAATCAAAGTCTAGTGGACTGTCTAGTCCCGTGACAAAGTCTTTCAATCGAGGCGAATGT | -1 |
| 69. | 2183 | Full | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGGGTKLEIKGGGGSGGGGSGGGGSVQLQQSGAELVRPGSSVKLSCKASGYAFSSYWMNWVKQRPGQLEWIGQIWPGDGTNYNGKFKGKATLTADESSSTAYMQLSSLASEDSAVIFCARRETTTVGRYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK | -1 |
| 70. | 2183 | Full | GATATTCAGCTGACACAGAGTCCTGCATCACTGGCTGTGAGCCTGGGACAGCGGGCAACTATCTCCTGCAAAGCCAGCCAGTCAGTGGACTATGATGGCGACTCCTATCTGAACTGGTACCAGCAGATCCCAGGGCAGCCCCCTAAGCTGCTGATCTACGACGCCAGCAATCTGGTGAGCGGCATCCCACCACGATTCAGCGGCAGCGGCAGCGGCACTGACTTCACCCTGAACATTCACCCAGTGGAGAAGGTGGACGCCGCTACCTACCACTGCCAGCAGTCCACAGAAGACCCCTGGACCTTCGGCCAGGGCACTAAACTGGAAATCAAGGGAGGGGGAGGGAGCGGCGGAGGAGGCTCAGGAGGAGGCGGATCAGTCCAGCTGCAGCAGAGCGGGGCTGAACTGGTCAGGCCAGGCAGCAGCGTGAAGCTGAGCTGTAAGGCCAGCGGGTACGCCTTCAGCAGCTACTGGATGAATTGGGTGAAGCAGCGGCCTGGTCAGCAGGAAGCTCCGTGAACAGGGCCAGGACAGGGCTGGAATGGATCGGCCAGATTTGGCCTGGGGAAATTTCCTGTAAGGCTTCTCGCTATGCCATTTCTAGTTACTGACGTAGAGTCAGTCAAGGCCAGGGA | -1 |

TABLE YY-continued

| SEQ ID No. | Clone | Description | sequence | |
|---|---|---|---|---|
| 71. | 2183 | VL | TGGAGACACCAACTAATAATGGAAAGTTCAAAGGCAAGGCCCACACTGACTGCTGTGACGAGTCAAGCTCCACAGCCTAAGCTCTAGTCTGTCTGGCAAGCGAGGATTCC GCCGTGACTTTTGCCTCGAAGACAGAAAGCCACACTGGGACGAGTGACTATTACGCTCCCTCAGCTCCTCGAGCGTGCCAAGCCCCAGAGGACCCAAGCGTGTTCCTGTTTCCCCCAGACGAACACCGATCATC CAAATCTCTGATAAGCACTTGTGTCGTGAGCGTGACCAAGCCCTGAAGTCAACTGTACCTGGATGGCGTCGAGTGCCATATGACACAACTGAGTGCCATGCTGAATGCCAAGTGACACTGCCAAACTAA CTCGGACACCCGAAGTCACTGTATAACTCCACTTACCGCGTCTGCTGTCTCCACAGGAGACAATTCCAAAAGACAATTTTATCCTTCGATATTGCCGTGACGTGGAGTGGCCAGAAACAATTCAAGACTACCCTCCAGTGCTGA GCCTAGGGAGGACCAGCCTGAGCCCCATCCAGAAGACAAATTCCACTGTATAACTCGAGAAGACAATTTTATCCTTCGATATTGCCGTGACGTGGAGTGGCCAGAAACAATTACAAGACTACCCTCCAGTGCTGA GGCACTGCAGCTCCAGCCCTGAGCCCCATCCAGAAGACAATTCCACTGTATAACTCGAGAAGACAATTTTATCCTTCGATATTGCCGTGACGTGGAGTGGCCAGAAACAATTACAAGACTACCCTCCAGTGCTGA GTCTCCCTGACATGTCTGGTGAAGACAGGGATTTTATCCTTCGATATTGCCGTGACGTGGAGTGGCCAGAAACAATTACAAGACTACCCTCCAGTGCTGA TTCTGACGGGAGTTTCCTCTGGTCAGTAAACTGACTGTGGATAAGTCACGTGGCAGCAGGGAAACGTCTTTAGTTGTTCAGTGATGCACGAGGCACTGCACAATCATT ACACCCAGAAGAAAGCCTGTCCCGTCTCCCGGCAAG | D1-K111 |
| 72. | 2183 | VL | DIQLTQSPASLAVSLGQRATISCKASQSVDYDGDSYLNWYQQIPGQPPKLLIYDASNLVSGIPPRSGSGTDFTLNIHPVEKVDAATYHCQQSTEDPWTFGGGTKLEIK | -1 |
|  |  |  | GATATTCAGCTGACACAGAGTCCTGCATCACTGGCTGTGAGCCTGGACAGCGAGCAAACTATCTCCTGCAAAGCCAGTCAGTCGACTATGATGGCGACTATCT GAACTGGTACCAGCAGATCCCAGGGCAGCCCCCTAAGCTGCTGATCTATGACGCGCTCAAATCTGGTGAGCGCCACGATTCAGCGGCAGCGGCTCTGGACT GATTTTACCCTGAACATTCACCCAGTCGAGAAGGTGACGCCGCTACCTACTGCCAGTGCCAGCATTGCCAGTGACCCCTGGACATTCGGCGGGGGAACTAAACTGAAA TCAAG |  |
| 73. | 2183 | L1 | QSVDYDGDSY | Q27-Y36 |
| 74. | 2183 | L1 | CAGTCAGTGGACTATGATGGCGACTCCTAT | -1 |
| 75. | 2183 | L3 | QQSTEDPWT | Q93-T101 |
| 76. | 2183 | L3 | CAGCAGTCTACCGAGGACCCCTGGACA | -1 |
| 77. | 2183 | L2 | DAS | D54-S56 |
| 78. | 2183 | L2 | GACGCCTCA | -1 |
| 79. | 2183 | VH | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAM DYWGQGTTVTVSS | Q127-S250 |
| 80. | 2183 | VH | CAGGTGCAGCTGCAGCAGAGCGGAGCAGAGCTGGTCAGACAGGAGCTCCGTGAAGATCAGCTGCAAGGCAAGCGGCTATGCATTTTCTAGTTACTGGATGAATTGGG TGAAGCAGAGGCCAGGACAGGGCCTGGAATGGATCGGACAGATTTGGCCCGGGGATGGAGACACTATAATGGAAAGTTCAAGGCAAGGCCACACTGACTGCT GACGCTGAGAGCAGCAGCACTGCTATATGCAGCTGTCTAGTCTGGCCAGCGAGGATTCCGCCGTCTACTTTTGCGCTCGAGAGAAACCACACTGTGGGCAGGTACTATTA CGCTATGGACTACTGGGGCCAGGGGACCACAGTCACCGTGTCAAGC | -1 |
| 81. | 2183 | H1 | GYAFSSYW | G152-W159 |
| 82. | 2183 | H1 | GGCTATGCATTTTCTAGTTACTGG | -1 |
| 83. | 2183 | H3 | ARRETTTVGRYYYAMDY | A223-Y239 |
| 84. | 2183 | H3 | GCTCGGAGAGAAACCACAACTGTGGGCAGGTACTATTACGCTATGGACTAC | -1 |

| SEQ ID No. | Clone | Description | Sequence | |
|---|---|---|---|---|
| 85. | 2183 | H2 | IWPGDGDT | I177-T184 |
| 86. | 2183 | H2 | ATTTGGCCCGGGGATGAGACACC | -1 |
| 87. | 2183 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A268-K377 |
| 88. | 2183 | CH2 | GCTCCTGAGGCTGCAGGAGGACCAAGGCTGTGTTCCTGTTTCCCCCTAAACCTAAGGACACACTGATGATCTCCGGACACCCGAAGTCACTTGTGTGTCTGAGCGTGAG CCACGAGGACCCTGAAGTCAATTCAACTGGTACGTGGACGGTGTCATAATGCCAAAACTAAGCCTAGGGAGGAACAGTATAACTCCACTTACCGCGTGTG TCTGTCCTGACCGTGCTGCATCAGGACTGGCTGAACGGAAAGGAGTACAAGTGCAAGGTGAGCAACAAGGCACTGCCAGCCCCATCGAGAAGACAATTTCCAAAGCA AAG | -1 |
| 89. | 2183 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G378-G483 |
| 90. | 2183 | CH3 | GGCCAGCCTCTGAGAACCACAGGTCTATGTGTACCCACCCCTCCCGGCAGACGAGCTCGACCAAAAACCAGGTCTGACCAAGAACCAGGTCAGCCTGACATGTCTGGTGAAGGGATTTTATCCTTCTGATAT TGCCGTGGAGTGGGAAAGTAATGGCCAGCCAGAAAACAATTACAAGACTACACCCCCTGTCCTGGATTCTGATGGGAGTTTCGCTCTGGTCAGTAAACTGACTGTGGAT AAGTCACGGTGGCAGCAGGGAAACGTCTTTAGTTGTTCAGTGATGCATGAAGCACTGCACAACCACTACACACAGAAAAGCCTGTCCCTGTCTCCGGGC | -1 |
| 91. | 2184 | Full | QVQLQQSGAELARPGASVKMSCKASGYTFTRYTMHWVKQRPGQGLEMIGYINPSRGYTNYNQKFKDKATLTTDKSSSTAYMQLSSLTSEDSAVYYCARYDDHYSLDYWGQ GTTLTVSSSTGGGGSGGGGGSDIQIVLTQSPAIMSASPGEKVTMTCSASSSVSYMNWYQQKSGTSPKRWIYDTSKLASGVPAHFRGSGSGTSYSLTISGMEAEDAATYY CQQWSSNPFTFGSGTKLEINRAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLT VLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFALVSKLTVDKSRWQQGN VFSCSVMHEALHNHYTQKSLSLSPGK | -1 |
| 92. | 2184 | Full | CAGGTCCAGCTGCAGCAGAGCGGAGCAGAGCTGGCTCGACCAGGAGCCTCGAATGGATCCGGAATGGATCAGCTGTAATGCAGCTCTCTAGTACAGAGGATCACTTCACTCGGTACACGATGCATTGGGTGAAGCAAAGGCCACCACA GATAAGAGCTCCTCTACAGCTTATCACCCTGACCGTGAGCTCCTGTAGTACAGAGGAGGAGCAGTGGACACTCAGGCGCAGGAAGCGACATTCCAGATTGTGCTGACC AGTCTCCAGCTCATATGTCCGCCAAGAAAGTCACTATGACATGTTCTCCGCCTCCTCGCCGCAGAAGTCACTATGAACATGGTATCAGCAGAAATCAAGATGACAGCC CCAAGAAGATGCCCTACTTATTGTCAGCAGTGGTCTAGTAACCTGACCGAAGTCAAGTTCAACTGGTACGTGACGGGTGCATATCGCCAAAACAAGCTAGGAGGAA GTCACATGCGTGGTCGTGAGCGTGAGCCAAGAAGCATCGATATCAACGACCTCACCCCAAGCTAATGGCAACAGAACCACTGTCCCGTGTCTGGACTGGTCTTT CGCACTGCGTCCAAACTGACAGTGGATAAGTCACGAGTGGCAGCAGGGAACGTCTTTTCTTGTGGTGATGCATGAAGCCCTGCACAATCATTACACTCAGAAATAC TGAGCCTGTCCCCGGCAAG | -1 |
| 93. | 2184 | VH | QVQLQQSGAELARPGASVKMSCKASGYTFTRYTMHWVKQRPGQGLEMIGYINPSRGYTNYNQKFKDKATLTTDKSSSTAYMQLSSLTSEDSAVYYCARYDDHYSLDYWGQ GTTLTVSS | Q1-S119 |
| 94. | 2184 | VH | CAGGTCCAGCTGCAGCAGAGCGGAGCAGAGCTGGCTCGACCAGGAGCAAGTGAATGCATCCAAGGCCTCTGGATACACCTTCACACGGTACACCATGCACTGGGTAAAGCAAGGCCACCA GATAAGAGCTCCTCTACAGCTTATATGCAGCTGAGTTCACTGAGTGAGGACAGTGCCGTACTATTGTGCTCGAGGACTACGATCATTACTCCCTGGATTATTGG GGGCAGGAACTACACCCGTGACCGTGAGCTCC | -1 |

TABLE YY-continued

| SEQ ID No. | Clone | Description | Sequence | |
|---|---|---|---|---|
| 95. | 2184 | H1 | GYTFTRYT | G26-T33 |
| 96. | 2184 | H1 | GGCTACACCTTCACACGGTATACT | -1 |
| 97. | 2184 | H3 | ARYYDDHYSLDY | A97-Y108 |
| 98. | 2184 | H3 | GCTCGGTACTATGACGATCATTACTCCCTGGATTAT | -1 |
| 99. | 2184 | H2 | INPSRGYT | I51-T58 |
| 100. | 2184 | H2 | ATTAACCCTAGCGAGGATACACC | -1 |
| 101. | 2184 | VL | QIVLTQSPAIMSASPGEKVTMTCSASSSVSYMNWYQQKSGTSPKRWIYDTSKLASGVPAHPRGSGSGTSYSLTISGMEAEDAATYYCQQWSSNPFTFGSGTKLEIN | Q140-N245 |
| 102. | 2184 | VL | CAGATTGTGCTGACACAGTCTCCAGCTATCATGTCCGCATCTCCGGGAGAAAAGTCACTATGACCTGCTCCGCTCAAGCTCCGTGTCTTACATGAATTGGTATCAGCAGAAATCAGGAACCAGCCCCAAGCGATGGATCTACGACACATCCAAGCTGGCATCTGGAGTGCCTGCACACCCAGGGGTCAGGGTCAGTGGCAGTGGATCTGGGACAAGCTACTTCACTCATTGGCAGCGGGACTAAGCTGGAGATCAAT TTAGCGGCATGGAGGCCGAGGATGCCGCTACCTACTATTGTCAGCAGTGGTCTAGTAACCCTTTCACTTTTGGCCAGGGGACTAAGCTGGAGATCAAT | -1 |
| 103. | 2184 | L1 | SSVSY | S166-Y170 |
| 104. | 2184 | L1 | AGCTCCGTGTCTTAC | -1 |
| 105. | 2184 | L3 | QQWSSNPFT | Q227-T235 |
| 106. | 2184 | L3 | CAGCAGTGGTCTAGTAACCCATTCACA | -1 |
| 107. | 2184 | L2 | DTS | D188-S190 |
| 108. | 2184 | L2 | GACACATCC | -1 |
| 109. | 2184 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A264-K373 |
| 110. | 2184 | CH2 | GCTCCAGAAGCTGCAGGAGGACCTTCCGTGTTCCTGTTTCCACCCAAACCAAAGGATACACTGATGATTAGCCGACACCCTGAGGTCACATGCGTCGTGGTCAGTCATGAGGACCCTGAGGTCAAGTTCAACTGGTACGTGGACGGCGTGGAGGTGCATAATGCCAAGACAAAGCCGCGGGAGGAGCAGTACAACAGTACGTGGTCCTGCACCAGGACTGGCTGAATGGCAAGGAGTACAAGTGCAAGGTCTCCAACAAAGCCCTCCCAGCCCCCATCGAGAAAACCATCTCTAAAGCTAAG | -1 |
| 111. | 2184 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G374-G479 |
| 112. | 2184 | CH3 | GGGCAGCCCCGAGAACCCACAGGTGTACACCCTGCCCCCATCCCGGGACGAGCTGACCAAGAACCAGGTCTCTCTGACCTGTCTGGTGAAAGGCTTTTACCCATCTGATATTGCAGTGGAGTGGGAGAGCAATGGGCAGCCCGAGAACAATTATAAGACAACTCCCCCTGTCCTGGACTCCGATGGCTCTTCCGCCTTGGTCAGCAAGCTGACAGTGGATAAGTCCAGATGGCAGCAGGGAAACGTCTTCTCTGTGTGAGTGTGTAATGCATGAAGCGCTGCATAACACCACTACACCCAGAAATCAGACTTCCCCGGC | G374-G479 |

TABLE YY-continued

| SEQ ID No. | Clone | Description | sequence | |
|---|---|---|---|---|
| 113. | 2185 | Full | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGGGTKLEIKGGGG SGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRE TTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRV VSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRW QQGNVFSCSVMHEALHNHYTQKSLSLSPGK | -1 |
| 114. | 2185 | Full | GATATTCAGCTGACCCAGAGTCCTGACATCACTGGCTGTGAGCCTGGGACAGCGAGCCAACAATCTCCTGCAAAGCCAGTCAGTGGACTATGATGGCGACTCCTATCT GAACTGGTACCAGCAGATCCCAGGGCAGCCCCCTAAGCTGCTGATCTACGACGCTTCAAATCTGGTAGGCGGCATCCCACGCAGGTTTCGGCGGGGAACCAAACTGAAA GATTTTACACTGAACATTCACCCAGTCGAGAAGGTGGACGCCGCTACCTACCACTGTCAGCAGTCTACAGAGGACCCCTGGACTTTCGGCGGGGAACCAAACTGAAA TCAAGGAGGAGGAGGAGGAGGCAGTCAGGAGGAGCCAGAGCCGTGGTCAGCAGAGCGGGCAGAGCAAGAAAGACTCAAAATCCTGGAAGCCAAAGGCTACGCCTTTTCTAGTTATTGGATGAATGGGGTGAAACAAAGACCAGGA TCAAGGAGGAGGAGGAGGCCAGTCAGGAGGAGCCAGAGCCGTGGTCAGCAGAGCGGGCAGAGCAAGAAAGACTCAAAATCCTGGAAGCCAAAGGCTACGCCTTTTCTAGTTATTGGATGAATGGGGTGAAACAAAGACCAGGA AAATTTCCTGTAAGGCTTCTGGCTATCCATTTTCACTAGTTACTGGATGAATTGGGTGAAGCAGAGGCCAGGGCAGGGCCTGGAATGGATCGGACAGATTTGGCCCGGGGA TGGAGACACAAACTATAATGGGAAAGTTCAAAGGCAAGGCCACACTGACTGCAGACAAATCCAGCAGCACAGCCTACATGCAACTCAGCAGCCTGACATCTGAAGAC TCCGCAGTCTACTTTTGCCCTCGATAAGAACACAGTAGGTCGCTATTACGATAGTGACTACTTTGACTACTGGGGCCAAGGAACCACGGTCACCGTCTCGAAC TCCGGAGCTCCAGCACCTTGTGTGGTCAGCACCATATAACCTGAAGAACAGTGATATACCTGAGCCGTCGTGCTCCTGTCTCCAAGGCAGGGCCATCCAGAAGCCCATGCCAGAGCCCAGCAGGTGCAATGCAGAGCTGACAAAAAACCAG GCCTAGGGAGGAAGACAGTATAACTCCAAGAAGCACATTTTCAAAGCCAACAGGCTTCAAAAGCCAACAGGAGTACAAATGCAAGGTGAGCAACAAA GTCTCCCTGCCTGTCTGATGGAGGAGAGATTCTACCCCCTTCTGTAATTGCTGTGAGTGGGAAAGTAATGGCCCAAGAAACAATTATCTGACTTGGCCTCCAGTGCTGGA TTCTGACGGAGTTCTTTCTGTACAGTAAAGCTGGATAAACTGACCTGACAGGAACAATCATT ACACCCAGAGAAAGCCTGTCCCTGTCTCCGGGCAAG | -1 |
| 115. | 2185 | VL | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGGGTKLEIK | D1-K111 |
| 116. | 2185 | VL | GATATTCAGCTGACCCAGAGTCCTGACATCACTGGCTGTGAGCCTGGGACAGCGAGCCAACAATCTCCTGCAAAGCCAGTCAGTGGACTATGATGGCGACTCCTATCT GAACTGGTACCAGCAGATCCCAGGGCAGCCCCCTAAGCTGCTGATCTACGACGCTTCAAATCTGGTAGGCGGCATCCCACGCAGGTTTCGGCGGGGAACCAAACTGAAA GATTTTACACTGAACATTCACCCAGTCGAGAAGGTGGACGCCGCTACCTACCACTGTCAGCAGTCTACAGAGGACCCCTGGACTTTCGGCGGGGAACCAAACTGAAA TCAAG | -1 |
| 117. | 2185 | L1 | QSVDYDGDSY | Q27-Y36 |
| 118. | 2185 | L1 | CAGTCAGTGGACTATGATGGCGACTCCTAT | -1 |
| 119. | 2185 | L3 | QQSTEDPWT | Q93-T101 |
| 120. | 2185 | L3 | CAGCAGTCTACAGAGGACCCCTGGACT | -1 |
| 121. | 2185 | L2 | DAS | D54-S56 |
| 122. | 2185 | L2 | GACGCTTCA | -1 |
| 123. | 2185 | VH | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTVGRYYYAM DYWGQGTTVTVSS | Q127-S250 |
| 124. | 2185 | VH | CAGGTGCAGCTGCAGCAGAGCGGAGCAGAGCTGGTCAGACAGGAAGCTCCGTCAAGATTTCGTGCAAGGCTTCCGGCTATGCATTTCTAGTTACTGGATGAATTGGG TGAAGCAGAGGCCAGGACAGGGCCTGGAATGGATCGGACAGATTTGGCCCGGGGATGGAGACACAAACTATAATGGGAAGTTCAAAGGCAAGGCCACTCTGACCGCT GACGAGTCAAGCTCAACTGCTTATATGCAGCTGTCAGTCCTGGCCAGCGAGGATTCCGCCGTCTACTTTTGCGCTCGAGAACGAACCACAGTTGGGCCAGGTACTATTA CGCAATGGACTACTGGGGCCAGGGGACCACAGTCACCGTCTCAAGC | -1 |

TABLE YY-continued

| SEQ ID NO. | Clone | Description | Sequence | |
|---|---|---|---|---|
| 125. | 2185 | H1 | GYAFSSYW | G152-W159 |
| 126. | 2185 | H1 | GGCTATGCATTTCTAGTTACTGG | -1 |
| 127. | 2185 | H3 | ARRETTTVGRYYYAMDY | A223-Y239 |
| 128. | 2185 | H3 | GCTCGGAGAGAAACCAACTGGGCAGTACTATTACGCAATGACTAC | -1 |
| 129. | 2185 | H2 | IWPGDGDT | I177-T184 |
| 130. | 2185 | H2 | ATTTGGCCGGGATGAGACACA | -1 |
| 131. | 2185 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A268-K377 |
| 132. | 2185 | CH2 | GCACCTGAGGCTGCAGGAGGACCGTGTTCCTGTTCCCCCCAAAGCCCAAGGACACCCTCATGATCTCTCGGACTCCTGAGGTCACCTGTGTCGTGTGAGCGTGTCCCACGAGGACCCTGAAGTTCAACTGGTACGTGGACGGTGTCGAGGTGCATAATGCCAAGACAAAACCCAGGGAGGAGCAGTATAACTCCACATACCGCGTCGTGTCCGTCCTGACCGTCCTGCACCAGGACTGGCTGAACGGCAAGGAGTACAAATGCAAGGTGTCCAACAAGGCACTGCCAGCCCCCATCGAGAAGACCATTTCCAAAGCCAAG | -1 |
| 133. | 2185 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G378-G483 |
| 134. | 2185 | CH3 | GGCCAGCCTCGAGAACCACAGGTCTATGTGCTGCCACCATCCAGAGAAGAACTGACCAAGAACCAGGTCAGCCTCCTGCGGGACTGGAGGAAGGGATTCTACCCTTCTGATATTGCTGTGGAGTGGGAAAGTAATGGCCAGCCAGAAAACAATTATCTGACCTGGCCTCCAGTGCTGGATTCTGACGGCTCTTCTTTCTGTACAGTAAGCTGACCGTGGATAAGTCACGGTGGCAGCAGGGAAACGTCTTTAGTTGTTCAGTGATGCACGAGGCCCTGCACAATCATTACACCCAGAAAAGCCTGTCCCTGTCTCCGGGCAG | -1 |
| 135. | 8074 | Full | QVQLQQPGAELVKPGTSVKLSCKSSGYTFTSYWIHWVKQRPGHGLEWIGEIDPSDNYTYYNQNFKGKATLTIDKSSTAYMQLNSLTSEDSAVFYCARSGYGNLFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 136. | 8074 | Full | CAGGTCCAGCTGCAGCAGCCTGGGGCTGAGCTGGTCAAGCCTGGGGCTTCCGTGAAGCTGTCATGTAAGTCCTCTGGATTCACTGGGTGAAGCAGCGACCAGGACATGGACTGCTGCACATGGCTGGAATGGATTGGAGAGATAGCGCCGTCTTTATTGCGGATAAATCAAGGGCAAGCAATCTGTTCGTTACTGATAAGTCGAGTGACTGTCCTCCTCGTTCTCACTGGACTAAGGCGTCTAGACATGCAGTCTCCACTGGACTAAGGCGCTCTAGACAGTGCAAGCTGGGCAGAGATGCCCACTCAGTGGGGAAGGGCGTCTAGATACGGCAGATCGTGCTGCTCGTGCACCAGAGAAATCAGGGTCCGCATGCTGGAGGAGGACCTGCAGACTATTGTTGTGAGACACTTCTCTGCTCTCTGTGATCAAGGATACAACTCTAAAGACAATTCTACCCTTCCGACATCGCCGTGGAGTGGGAAAGTAATGGCCAGCCCAGAATTCAACTCTGGACCTCCAGTGCTGGATTCTGATGGAGAAACAGTACACTACACTCCCAATGGACAGTCGATTCAAAGCTCGATAAGGCCGGTGCAGCAGGGAAACGTCTTCAGCTCCTGAATGCTGCACACCACGAAGCACTGCACAATCATTACACCAGAGAGGTTCCCTGTCCCTGTCACCTGGC | -1 |

TABLE YY-continued

| SEQ ID No. | Clone | Description | Sequence | |
|---|---|---|---|---|
| 137. | 8074 | VH | QVQLQQPGAELVKPGTSVKLSCKSSGYTFTSYWIHWVKQRPGHGLEWIGEIDPSDNYTYNQNFKGKATLTIDKSSTAYMQLNSLTSEDSAVFYCARSGYGNLFVYWGQGTLVTVSA | Q1-A118 |
| | | | CAGGTCCAGCTGCAGCAGCCTGGGGCAGGACCTGGGGTCAAACCTGGCACTTCAGCTGTCAAACCTGGCACTTCAGCTGTCAAACCTGGCACTTCAGCTGTCAAGCAGCGACCAGGACCTGGAGTGGATCGGAGAAATTGACCCTAGTGATAACTACACCTACAACCAGAATTTCAAGGGCAAGGCCACTCTGACTGCAGACAAGCCTCTACTACTGCAGCTGAATAGTCTGACCTCAGAAGATTCTGCGCGTCTTTTATTGCGCCGATCGGATAACCTGTTCGTCTATTGGGCCAGGGAACCCTGGTCACCGTCTCTGCT | -1 |
| 138. | 8074 | VH | | |
| 139. | 8074 | H1 | KSSGYTFTSYW | K23-W33 |
| 140. | 8074 | H1 | AAATCCTCTGGCTATACTTTTACATCCTACTGG | -1 |
| 141. | 8074 | H3 | ARSGYGNLFVY | A97-Y107 |
| 142. | 8074 | H3 | GCTAGAAGCGGATACGGCAATCTGTTCGTCTAT | -1 |
| 143. | 8074 | H2 | IDPSDNYT | I51-T58 |
| 144. | 8074 | H2 | ATTGACCCTAGTGATAACTACACC | -1 |
| 145. | 8074 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A119-V216 |
| 146. | 8074 | CH1 | GCTAGCACTAAGGGCCCTTCCGTGTTCCACTGGCTGTCTTGACAAGTGGAGTCCATATCTTTCCCGAGTCTGCAGTCAAGCGACTCTACTCCCGTCCTGTGGTCACCGTGCCTAGTTCAAGCCTGGGGCTGGAACTCAGGGGCTTCCAGGGCTTCCAGCGACATATATCTCAACGTGAATCACAAGCCATCAACACAAAGGTCGACAAGAAAGTG | -1 |
| 147. | 8074 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A232-K341 |
| 148. | 8074 | CH2 | GCGCCAGAACTGCTGGAGGACCAAGCGTGTTCCTGTTTCCACCCAAGCCTAAAGACACCCTGATGATTTCCCGGACTCCTGAGGTCACCTGCGTGGTGGTCGATGGTCTCACGCAGGAGGACCCCGAAGTCAAGTTCAACTGGTACGTGGATGGCGTCGAAGTGCATAATGCCAAGACCAAGCCCCAAGTCAAAGCAAAGCCCCGGGAGGAACAGTACAACTCTACCTATAGAGTCGTAAGTGTCCTGACAGTCCTGCACCAGGACTGGCTGAATGGGAAGGAGTATAAGTGTAAGGTCTCCAACAAAGCCCTCCCAATCGAAAAAACATCTCTAAAGCAAAA | -1 |
| 149. | 8074 | CH3 | GQPREPQVYVLPPSRDELTKNQVSLTCLVKGFYPSDIAVEWESNGQPENNYLTWPPVLDSDGSFFLYSKLTVDKSRWQQGNVFSCSVMHEALHNHYTQKSLSLSPG | G342-G447 |
| 150. | 8074 | CH3 | GGACACGCCTCCGCAACCACAGTCTACGTGCTGCCCCCCAGCCGCGACGAACTGACTAAAAATCAGGTCTCTCTGTCTGTCTGGTCAAAGGATTCTACCCTTCCGACATCGCCGTGGAGTGGGAAAGTAACGGCCAGCCCGAGAACAATTACCTGACCTGGCCCCCGTGCTGGACAGTGACGGGAGTTCTTTCTGTATTCAAAGCTGACAGTGATAAAGCGCGTGGCAGCCAATGTTCTCAGCTGTCCATGCAGTCCGTGATGCACGAAGCACTCCACAACCATTACACTCAGAAGTCCCTGTCCCTGTCACCTGGC | -1 |
| 151. | 3344 | Full | QVTLRESGPALVKPTQTLTLTCTFSGFSLSTSGMGVGWIRQPPGKALEWLAHIWWDDDKRYNPALKSRLTISKDTSKNQVVLTMTNMDPVDTAAYYCARMELWSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK | -1 |

TABLE YY-continued

| SEQ ID No. | Clone | Description | Sequence | |
|---|---|---|---|---|
| 152. | 3344 | Full | CAGGTGACACTGAGAGAATCCGGCCCAGCCCTGGTGAAGCCCTCAGACCCACTCAGCCTGACCTTGCACCTTCTCTGGGTTTCCCTGTCTACAAGTGGATGGGAGTGGGATGGATCAGGCAGCCACCTGGACAATGACCCTGACCAATTGGTGGCTGCTCACTATATGCCGACGATGACAGCAAGGATACTTCCAAAAACCAGGTGGTCCTGACAATGACCCTGACCAATTGGTGGACACAGCCGCTTACTATTGCCGTGGAACCTGTGTTCTCTGGCACCATCTGGACTAAATCAACCAGCGGAGCAGAACAGCAGCACTGGTGGGCAGGGAACACTGGTCACTGTGTCTTGAGCTACCAGGTGGAACACTGGTCACTGTTTCCCTGAGCTACCAGGTGGAACTGTTCCCAAAAATCATGCCAGCCTGGTTCCCCACCATCTGCCCAGGTGGAACCTGTGCTGCTCCTAGTTCCAATGTCCCACCATCTGCCCAGCTGGATGTGAGCCACAGGACCCCTGACTGTGTCTGCAGCCCTCAGTCTCAGTGTATCCCCTAGCCGTGTATCCCGGGGATGAGCTGACTAAGAACCAGGTCTCCTGACCCTCGTGTGAAAGGATTTTACCCTGGACAAATGACAGTGTTGGAGTGGGAACGTCTTTTCTGTGATGCATGAGGCTCTGCACAATCATTACACCAGAAGAGTCGTCACTGAGCCCGGGCAAA | −1 |
| 153. | 3344 | VH | QVTLRESGPALVKPTQTLTLTCTFSGFSLSTSGMGVGWIRQPPGKALEWLAHIWDDDKRYNPALKSRLTISKDTSKNQVVLTMTNMDPVDTAAYYCARMELWSYYFDYWGQGTLVTVSS | Q1-S120 |
| 154. | 3344 | VH | CAGGTGACACTGAGAGAATCCGGCCCAGCCCTGGTGAAGCCCACTCAGACCCTCACCCTGACCTGCACCTTCTCTGGGTTTCCCTGTCTACAAGTGGATGGGAGTGGGATGGATCAGGCAGCCACCTGGGAAAAAGGCTGAGTGGCTGGCTCACATTTGGGACGATGACAAGCGGTACAATCCAGCCTAAAGGCAGCCACTGACCATCTCCAAAGACACCAGCAAGAACCAGGTGGTCCTGACAATGACCAATATGGACCCCGTGGACACAGCCGCTTACTATTGCGCCGCTTACTATTGCGCCGTCTATGGCCGAACTGTGGAGCTACTATTTCGACTACTGGGGCCAGGGAACACTGGTCACTGTGAGCTCC | −1 |
| 155. | 3344 | H1 | GFSLSTSGMG | G26-G35 |
| 156. | 3344 | H1 | GGGTTTCCCTGTCTACAAGTGGGATGGA | −1 |
| 157. | 3344 | H3 | ARMELWSYYFDY | A98-Y109 |
| 158. | 3344 | H3 | GCCCGCATGGAACTGTGGAGCTACTATTTCGACTAC | −1 |
| 159. | 3344 | H2 | IWDDDK | I53-K59 |
| 160. | 3344 | H2 | ATTTGGTGGACGATGACAAG | −1 |
| 161. | 3344 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A121-V218 |
| 162. | 3344 | CH1 | GCTTCTACTAAGGGACCCAGTGTCTTCCCTCTGGCACCATCTAGTAAATCAACCAGCGGAGAACAGCAGCCGGATGTCTGGTGAAGGATTATTTCCCTGAGCCAGTCACCGTGTCCTGGAACTCTGGAGCTCTGACCAGCGGGGTGCATACCTTCCCAGCAAGCCTGTACTCTCTGTCCAGCGTGGTCACCGTGCCTAGTTCAAGCCTGGGAACCCAGACATACATATGCAACGTGAATCACAAGCCCTCTAATACAAAGGTCGATAAGAAAGTG | −1 |
| 163. | 3344 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A234-K343 |
| 164. | 3344 | CH2 | GCACCTGAGCTGCTGGGAGGCCCTTCCGTGTTCCTGTTCCCTCCAAAGCCAAAGGATACACTGATGATTAGCCGAACTCCTGAAGTGACCTGCGTGGTCGTGGATGTGAGCCACGAGGACCCAGAAGTCAAGTTCAATTGGTACGTGGACGGCGTCGAAGTGCATAATGCTAAGACAAAGCCAAGGGAGGAACAGTACAATAGCACTTACCGTGTTGTGTCCGTGCTGACAGTGCTGCACCAAGACTGGCTGAATGGCAAGGAGTATAAGTGCAAAGTGCAAAGTCCAATAAGGCTCTGCCAGCACCCATCGAGAAAACCATTTCTAAGGCTAAA | −1 |

TABLE YY-continued

| SEQ ID No. | Clone | Description | Sequence | |
|---|---|---|---|---|
| 165. | 3344 | CH3 | GQPREPQVYVPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G344-G449 |
| 166. | 3344 | CH3 | GGCCAGCCCCGAGAACCTCAGGTCTACGTGCCCCCAGCGCCCGGAGAACTCAGGTCTACCTGCTGTCTGGTTGAAGGATTTTACCCAAGTGACATTGCAGTGGAGTGGGAATCAAATGGCCAGCCGGAATATAAGAACCACCCCGTCTGGATAGTGACGACTAAGAGCCGGTGGCAGCAGGGGAACGTCTTTTCTTGCTCTGTTATGCATGAGGCTCTCCAAGCTGACTGTGGACAAATCTAGGTGGCAGCAGGGCCCCCGGC | -1 |
| 167. | 3345 | Full | QVTLRESGPALVKPTQTLTLTCTFSGFSLSTSGMGVGWIRQPPGKALEWLAHIWWDDDKRYNPALKSRLTISKDTSKNQVVLTMTNMDPVDTAAYYCARMELWSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLITWPPVLDSDGSFFLYSKLTVDKSRWQQGNVFSCSVMHEALHNHYTQKSLSLSPGK | -1 |
| 168. | 3345 | Full | CAGGTGACACTGAGAGAATCCGAAGCCAGCAGCTGGTTAAGCCAACTCAGACACTCTGACCCTGACCTGCACATTCTCTGGGTTTTCCCTGAGCACCAGTGGGATGGGAGTGGGATGGAATCAGGCAGCCTGGAAAGGCACTGGAGCTGGCTCACATTTGGTGGGATGATGACAAGCGCTACAATATGGCACCCCGTCTCTGGGACACTGTCTTCTCTGAATAAATCAAACGCTAGTAATCACAACGCGGAGAACTGACGAGTAAATCAAGACTGAGCACTGGGATGTCTGTGCCCATACTTTTTCCCGTGTCTCAGTCAAGCGCTGTACACTGCTCTGTCTGGCAGTGCCACAGAGACTGATCTCAACCTGAATCACAAGCCCCTCTAATACTAAAGTGCGATAAGAAAGTGGAACCTAAGAGTGTCCAGTCGGTCCTGGAGCTGCCTGGGGAGTAAGTGCTGACAGCAGTCAAATCTGAGAGAAAAAACCATTTCTAAGGCAATGGAGCCTGATCGCACAGGAGGGAAGGAGTATAAGTGCAAAGTGTCCAATAAAGGCTCTGCCAGCACCATTGAGAAAGATTTCAAGGCTAAGAGCCGGATGACCTACGTGCTGCCCCCTAGCAGGGAGAGCTGACCAAGAACCAGGTCTCCTGCTGTCTGTGAAAGGATTCTATCCAAGCTGACATTGCCGTGGAATCAAATGGCCAGCCCGAAAACAATTACCTACTTGGCCACCCGTGCTGGATAGTGACGGCTCATTCTTTCTGTATTCCAAGCTGACCGTGGACAAGTCTAGGTGGCAGAGGGAACGTCTTTTCTGTGATGCATGAGGCCCTGCACAATCATTACACCCAGAAAGTCTGTCACTGGGAAA | -1 |
| 169. | 3345 | VH | QVTLRESGPALVKPTQTLTLTCTFSGFSLSTSGMGVGWIRQPPGKALEWLAHIWWDDDKRYNPALKSRLTISKDTSKNQVVLTMTNMDPVDTAAYYCARMELWSYYFDYWGQGTLVTVSS | Q1-S120 |
| 170. | 3345 | VH | CAGGTGACACTGAGAGAATCCGAAGCCAGCAGCTGGTTAAGCCAACTCAGACACTCTGACCCTGACCTGCACATTCTCTGGGTTTTCCCTGAGCACCAGTGGGATGGGAGTGGGATGGAATCAGGCAGCCTGGAAAGGCACTGGAGCTGGCTCACATTTGGTGGGATGATGACAAGCGCTACAATATGGCACCCCGTCTCTGAAGAGCAGACTGACCATTTCTAAAGACAGACGACTAAGAACCAGGTCGTGCTTACTATGACCAATATGGACCCCGTGGACACTGCTGCCTACTACTGCGCCAGGATGGAGCTGTGGAGCTACTATTTCGACTACTGGGGCCAGGGAACTCTGGTCACCGTGAGCTCC | -1 |
| 171. | 3345 | H1 | GFSLSTSGMG | G26-G35 |
| 172. | 3345 | H1 | GGGTTTTCCCTGTCTACAAGTGGGATGGGA | -1 |
| 173. | 3345 | H3 | ARMELWSYYFDY | A98-Y109 |
| 174. | 3345 | H3 | GCTCGCATGGAACTGTGGAGCTACTATTTCGACTAC | -1 |
| 175. | 3345 | H2 | IWWDDDK | I53-K59 |
| 176. | 3345 | H2 | ATTTGGTGGGACGATGACAAG | -1 |
| 177. | 3345 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A121-V218 |

TABLE YY-continued

| SEQ ID No. | Clone | Description | sequence | |
|---|---|---|---|---|
| 178. | 3345 | CH1 | GCTTCTACCAAGGGACCCAGTGTTCCTGGCACCATCTAGTAACAACAAGCGGAGGAACTGCAGCACTGGATGCTGTGAAGGATTATTCCCTGAGCCAGT CACCGTGTCCTGGAACTCTGGCGCACTGACAAGTGGGGTCACTGATATCTGCAACGTGAATCACAAGCCCTCTAATACTAAGTCGATAAGAAGTG CAAGCCTGGGACACAGACTTATATCTGCAACGTGAATCACAAGCCCTCTAATACTAAGTCGATAAGAAGTG | -1 |
| 179. | 3345 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A234-K343 |
| 180. | 3345 | CH2 | GCTCCTGAGCTGCTGGGAGGACCTTCCGTGTTCCTCTTCCCAAAGCCAAAGGACACACTGATGATTAGCCGAACCCCTGAAGTCACATGCGTGGTCGTGGATGTGAG CCACGAGGACCCCAGAGTCAAGTTCAATTGGTACGTGGACGGCGTCGAGGTGCATAATGCCAAGACCAAACCTAGGGAGGAACAGTACAATTCAACCTATCGCGTCGT GAGCGTCCTGACAGTGCTGCACCAGGATTGGCTGAACGGAAGGAGTATAAGTGCAAAGTGTCCAATAAGGCTCTGCCAGCACCCATCGAGAAAACCATTTCTAAGGCA AAA | -1 |
| 181. | 3345 | CH3 | GQPREPQVYVLPPSRDELTKNQVSLLCLVKGFYPSDIAVEWESNGQPENNYLITWPPVLDSDGSFFLYSKLTVDKSRWQQGNVFSCSVMHEALHNHYTQKSLSLSPG | G344-G449 |
| 182. | 3345 | CH3 | GGCCAGCCCCGAGAACCTCAGGTGCTACGTGCTGCCCCCCTAGCCGGGATGAGCTGACAAAGAACCAGGTCTCCCTGCTGTGTCTGGTGAAGGATTCTATCCAAGTGACA TTGCCGTGGAGTGGGAGTCCAACAATTACCTGGCCTGGATAGTGACGGCTCATTCTTTCTGTATTCTTCCAAGCTGACCGTGGACAAAAGAAGAAGCTGGAC AATCTAGGTGCCAGGGAACGTCTTTCATTCTGTACAGCATGCACGAGGCCCTGCACAATCATTACACCCAGAGAGTCTGTCACTGAGCCCCGGC | -1 |
| 183. | 3346 | Full | EIVLTQSPATLSLSPGERATLSCSASSSVSYMHWYQQKPGQAPRLLIYDTSKLASGIPARFSGSGSGTDFTLTISSLEPEDFAVYYCFQGSVYPFTFGQGTKLEIKRTVAA PSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | -1 |
| 184. | 3346 | Full | GAAATCGTCCTGACACAGAGTCCTGCTACTCTGTCACTGAGCCCAGGCGAGCGGGCCACTCTGAGCTGCAGCGCCAGCAGCAGCGTCAGCTACATGCACTGGTATCAGCAA AAGCCAGGACAGGCACCCAGACTGCTGATCTACGACACCTCTAAACTGGCAAGTGGCATCCCCGCCAGATTCAGTGGCAGTGGATCCAAAGGACTGGCC GCTCCATCCGTCTTCATTTTCCCCCTCAGTTCCAGTTCCAGATTCACCCTTGGCAGGGACAGCAGCTCACAGGATGAACAATTCTACCCCCCGAGGTCCAAGGTCCAGTGG AAGTGCAAACGCTCTGCAGTCCAGTCAACGACAGAGAGTCGACTGAACAAAGTGACAATCACCATCAGAGCTGTCTAGTCCCGTGACTAACATCCTTTAACAGAGGCAATGT ATTACGAGAAGCACAAAGTGTATGCCTGCGAAGTCACCATCACAGGGACTGTCTAGTCCCGTGACTAACATCCTTTAACAGAGGCAATGT | -1 |
| 185. | 3346 | VL | EIVLTQSPATLSLSPGERATLSCSASSSVSYMHWYQQKPGQAPRLLIYDTSKLASGIPARFSGSGSGTDFTLTISSLEPEDFAVYYCFQGSVYPFTFGQGTKLEIK | E1-K106 |
| 186. | 3346 | VL | GAAATCGTCCTGACACAGAGTCCTGCTACTCTGTCACTGAGCCCAGGCGAGCGGGCCACTCTGAGCTGCAGCGCCAGCAGCAGCGTCAGCTACATGCACTGGTATCAGCAG AAGCCAGGACAGGCACCCAGACTGCTGATCTACGACACCTCTAAACTGGCAAGTGGCATCCCCGCCAGATTCAGTGGCAGTGGATCCAAAGGACTTCACCCTGACAA TCAGTTCACTGGAGCCCGAAGATTTCGCCGTCTACTATTGCTTTCAGGGACAGCAGCTCACAGGGACAAAGCTGGAGATCAAA | -1 |
| 187. | 3346 | L1 | SSVSY | S27-Y31 |
| 188. | 3346 | L1 | TCCTCTGTGTCCTAC | -1 |
| 189. | 3346 | L3 | FQGSVYPFT | F88-T96 |
| 190. | 3346 | L3 | TTTCAGGGCAGCGTCTATCCTTTCACC | -1 |
| 191. | 3346 | L2 | DTS | D49-S51 |
| 192. | 3346 | L2 | GACACCTCT | -1 |

TABLE YY-continued

| SEQ ID No. | Clone | Description | Sequence | |
|---|---|---|---|---|
| 193. | 3346 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R107-C213 |
| 194. | 3346 | CL | AGGACTGTGGCCGCTCCATCCGTCTTCATTTTCCCGCCCTCTGATGAGCAGTTGAAATCTGGAACTGCCTCTGTCGTGTGCCTGCTGAATAACTTCTATCCCAGAGAGGCCAAAGTACAGTGGAAGGTGGATAACGCTCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT | -1 |
| 195. | 1015 | Full | EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYKTTPPVLDSDGSFFLYSKLTVDKSRWQQGNVFSCSVMHEALHNHYTQKSLSLSPGK | -1 |
| 196. | 1015 | Full | GAGGTGCAGCTGGTGGAAAGCGGAGGAGGACTGGTGCAGCCTGGCGGAAGCCTGCGCCTGAGTTGCGCCGCTTCAGGATTCAACATCAAGGACACATTCACTGGGTGCGACAGGCTCCAGGAAAACACTGGAGTGGGTGGCGCGCATTTACCCTACCAATGGATATACACGCTACGCGGACTCCGTGAAGGGACGGTTTACTATTAGCGCCGATACATCCAAAAACACGCTTACCTGCAGATGAACAGCCTCCGCGCTGAAGATACCGCTGTGTATTACTGTAGCCGTTGGGGAGACGGATTCTACGCTATGGATTGGATGTCTGGTAAGGAACTATTTCCCTGACGGTGACAGTTCAGCCGGTGGTCTCGGAGGGCAGATGATCAATCAAAAGCCTCAGCAATCAAAGGAGAGGACCAGCAAAGCCCTGGGCCACTGCCGCAGCAGGTAAATCCAAGTGTTTAGTGTTGGCATCAATCAAATCCAAGGGACCCCAAGTCACAGACCAAGCGAAGCGGGCGATATCGAGAACTGACGCGTGTTCAGCTGTTGAAGGGAGGCATGTCGAAGGACAGAGTCAGGACAAAACCAAGAGCAGTACACAGCGAGCTGCAAAACCTTCAGCAGGCCCGTCCAGATCAAGAAATCCCTCAGCCGCAGATATCTGATAATCTGCGATCTCCAGCTCTTACGCGAGGCTGGAATCAATGAGCAGCCTGGACGAGTGGTCATTCTTCGGACAAGACCCCAGGAGGCCAAAAGCCAAGCTGCCCCGTGTCCCTGCTGTTCTCCTGTCTGTCTGTGCCAGCTGGCAGCTTCTTCCTGTATTCAAGCCTCACCGTGGACAAGAGCAGATGGCAGCAGGGCAACGTGTTTAGTTGTTCAGTGATGCATGAAGCCCTGCACAATCATTACACCTCAGAAGAGCCTGTCCCTGGACCAAAACTCCGGCCCAGATCATCCACTGTTTGCGGGCCTGGGCACCCTGGCCGATTTCAGTGTCCAGCTGACTAA | -1 |
| 197. | 1015 | VH | EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGDGFYAMDYWGQGTLVTVSS | E1-S120 |
| 198. | 1015 | VH | GAGGTGCAGCTGGTGGAAAGCGGAGGAGGACTGGTGCAGCCTGGCGGAAGCCTGCGCCTGAGTTGCGCCGCTTCAGGATTCAACATCAAGGACACATTCACTGGGTGCGACAGGCTCCAGGAAAACACTGGAGTGGGTGGCGCGCATTTACCCTACCAATGGATATACACGCTACGCGGACTCCGTGAAGGGACGGTTTACTATTAGCGCCGATACATCCAAAAACACGCTTACCTGCAGATGAACAGCCTCCGCGCTGAAGATACCGCTGTGTATTACTGTAGCCGTTGGGGAGACGGATTCTACGCTATGGATT | -1 |
| 199. | 1015 | H1 | GFNIKDTY | G26-Y33 |
| 200. | 1015 | H1 | GGATTCAACATCAAGGACACCTAC | -1 |
| 201. | 1015 | H3 | SRWGDGFYAMDY | S97-Y109 |
| 202. | 1015 | H3 | AGTCGATGGGGAGGAGGACGGATTCTACGCTATGGATTAT | -1 |
| 203. | 1015 | H2 | IYPTNGYT | I51-T58 |
| 204. | 1015 | H2 | ATCTATCCCACTAATGATACACC | -1 |

TABLE YY-continued

| SEQ ID No. | Clone | Description | Sequence | |
|---|---|---|---|---|
| 205. | 1015 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A121-V218 |
| 206. | 1015 | CH1 | GCCTCTACCAAGGGCCCCAGTGTTCCCCCTGGCTCCTTCTAGTAAATCCACCTCTGGAGGCACAGCCGCTCTGGGATGTCTGGTGAAGGACTATTTCCCCGAGCCTGTGACCGTGAGTTGGAACTCAGGCGCCCTGACCAGCGGAGTGCACACCTTTCCTGCTGTGCTGCAGTCAGCCTCCAGCGGTCTACTCCCTGTCCTCTGTGGTGACAGTGCCAAGTTCAAGCTGGGCACCCAGACTTATATCTGCAACGTGAATCATAAGCCCTCAAATACAAAAGTGACAAGAAAGTG | -1 |
| 207. | 1015 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A234-K343 |
| 208. | 1015 | CH2 | GCTCCAGAACTGCTGGGAGGACCTAGCGTGTTCCTGTTTCCCCCTAAGCCAAAGGACACTCTGATGATTTCCAGGACTCCCGAGGTGACCTGCGTGGTGGTGGACGTGTCTCACGAGGACCCCGAAGTGAAGTTCAACTGGTACGTGGATGGCGTGGAAGTGCATAATGCTAAGACAAAACCAAGAGAACAGTACAACAGCACTTACAGAGTGGTGTCCGTGCTGACCGTGCTGCATCAGGATTGGCTGAATGGCAAAGAATACAAGTGCAAAGTCAGTAATAAGGCCCTGCCTGCCAATCGAGAAAAAACCATCTCTAAGGCCAAA | -1 |
| 209. | 1015 | CH3 | GQPREPQVYTLPPSRDELTKNQVSLTCLVKGFYPSDIAVEWESNGQPENNYLTWPPVLDSDGSFFLYSKLTVDKSRWQQGNVFSCSVMHEALHNHYTQKSLSLSPG | G334-G449 |
| 210. | 1015 | CH3 | GGCCAGCCAAGGGAGCCCCAGGTGTACGTGCTGCCACCAAGCCGAGACTGACCAAGAACCAGGTGTCCCTGACCTGTCTGGTCAAGGGCTTCTACCCTAGTGATATTGCTGTGGAGTGGGAATCAAATGGACAGCCAGAGAACAATTACCTGACCTGGCCTCCAGTGCTGGACAGCGATGGCAGCTTCTTCCTGTATTCCAAGCTGACAGTGGATAAATCGATGGCAGCAGGGGAACGTGTTTAGTTGTTCAGTGATGCATGAAGCCCTGCACAATCATTACACTCAGAAGAGCCTGTCCCTGTCTCCGGGC | -1 |
| 211. | 9287 | Full | QVQLVQSGSELKKPGASVKVSCKASGYTFTRYTMHWVRQAPGQGLEWIGYINPSRGYTNYNQKVKGRFTISTDNSKNTAYLQMDSLRAEDTGVYFCARYDDHYSLDYWGQGTLVTVSSVSSEGGSVQPGGSGGSGGVDDIQMTQSPSSLSASVGDRVTITCSASSSVSYMNWYQQKPGKAPKLLIYDTSKLASGVPSRFSGSGSGTDYTLTISSLQPEDAATYYCQQWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 212. | 9287 | Full | CAGGTGCAGCTGGTGCAGAGCGGAGAGGAAGGTGTGCAGCCAGGCCAGGTCGTCTGTTCCTGTGAAGGCCCGGTCCCTGAGACTGTCTTGTGCAAGGCCAGCGGCTACACCTTCACAAGGTATACCATGCACTGGGTGCGCCAGGCCCCAGGACACGGGCTGGAGTGGATCGGCTATATCAACCCTAGCAGGGGTTACACCAACTATAATCAGAAGGTGAAGGGCCGCTTCACCATCTCCACAGACAACTCTAAGAATACCGCCTACCTGCAGATGGACAGCCTGAGAGCCGAGGACACCGGCGTGTATTACTGTGCCAGATACGATGATCACTATAGCCTGGATTATTGGGGCCAGGGCACCCTGGTCACCGTGTCTTCCGTGAGCTCCGAGGGAGGCTCTGAGGCCAAGGGCAGCCACCCGTGTCCCCCGTCCCAGGGAGAGTCCCAGATGACCCAGTCACCTAGCTCCCTGTCCGCCAGCGTGGGAGACAGAGTGACAATCACATGTAGTGCCAGCTCCTCAGTGAGCTACATGAATTGGTACCAGCAGAAGCCCGGAAAGGCCCCTAAGCTGCTGATCTATGACACCAGCAAGCTGGCATCTGGAGTGCCCTCCAGGTTCAGCGGCTCTGGATCTGGCACCGACTATACACTGACAATCAGCAGCCTGCAGCCCGAGGATGCCGCCACATATTATTGCCAGCAGTGGAGCAGCAACCCCTTTACTTTCGGCCAGGGCACCAAGCTGGAGATCAAAGCCGCCGAGCCCAAGTCTAGCGACAAGACCCACACATGCCCACCTTGCCCTGCCCCAGAGGCCGCAGGCGGGCCCTCCGTGTTCCTGTTCCCCCCTAAGCCTAAAGACACCCTGATGATCAGCAGAACCCCTGAGGTGACCTGCGTGGTGGTGGATGTGAGCCACGAGGACCCTGAGGTCAAGTTCAATTGGTATGTGGATGGGGTGGAAGTGCACAATGCCAAGACAAAGCCTAGAGAGGAGCAGTACAACAGCACCTACCGCGTGGTGTCCGTGCTGACAGTGCTGCACCAGGACTGGCTGAATGGCAAGGAATACAAGTGCAAGGTCAGCAACAAGGCCCTGCCAGCCCCCATCGAGAAGACCATCTCTAAGGCCAAGGGCCAGCCCAGGGAGCCACAGGTGTACACACTGCCTCCATCTCGGGAGGAGATGACCAAGAATCAGGTGTCCCTGACCTGCCTGGTCAAGGGCTTCTATCCAAGCGATATCGCCGTGGAGTGGGAGAGCAATGGCCAGCCCGAGAACAATTACAAGACCACTCCTCCTGTGCTGGACTCTGATGGCAGCTTCTTCCTGTATTCCAAGCTGACAGTGGATAAGTCTAGGTGGCAGCAGGGCAACGTGTTTTCTTGCAGCGTGATGCACGAGGCCCTGCACAATCACTACACCCAGAAGTCCCTGTCTCTGAGCCCCGGC | -1 |
| 213. | 9287 | VH | QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYDDHYSLDYWGQGTLVTVSS | Q1-S119 |
| 214. | 9287 | VH | CAGGTGCAGCTGGTGCAGAGCGGAGGCGGAGTGGTCCAGCCAGGCAGGAGCCTGAGACTGTCTTGTAAGGCCTCACCTTCACAAGGTATACCATGCACTGGGTGCGCCAGGCACCAGGCAAGGGACTGGAATGGATCGGCTACATCAACCCTAGCAGAGGGTACACAAACTATAATCAGAAGGTGAAGGGCCGCTTCACCATCTCCACA | -1 |

TABLE YY-continued

| SEQ ID No. | Clone | Description | sequence | |
|---|---|---|---|---|
| | | | GACAACTCTAAGAATACCGCCTACCTGCAGATGAACTCCCTGAGGGCCGAGGATACCAGCCGTGTATTTTTGCGCCCGCTACTATGACGATCACTACAGCCTGGATTATTG GGGCCAGGGCACCCTGGTGACAGTGAGCTCC | |
| 215. | 9287 | H1 | GYTFTRYT | G26-T33 |
| 216. | 9287 | H1 | GGCTACACCTTCACAAGGTATACC | -1 |
| 217. | 9287 | H3 | ARYYDDHYSLDY | A97-Y108 |
| 218. | 9287 | H3 | GCCCGCTACTATGACGATCACTACAGCCTGGATTAT | -1 |
| 219. | 9287 | H2 | INPSRGYT | I51-T58 |
| 220. | 9287 | H2 | ATCAACCCTAGCAGGGGCTACACA | -1 |
| 221. | 9287 | VL | DIQMTQSPSSLSASVGDRVTITCSASSSVSYMNWYQQKPGKAPKRLIYDTSKLASGVPSRFSGSGSGTDYTLTISSLQPEDAATYYCQQWSSNPFTFGQGTKLEIK | D138-K243 |
| 222. | 9287 | VL | GATATCCAGATGACCCAGAGCCCTTCAGCCCTGTCTGCGTCTGTGGGCGACAGGGTGACCATCACATGTAGCGCCTCCTCCTTAGCGTGTCCTACATGAACTGGTATCAGCA GAAGCCAGGCAAGGCCCCCAAGCGGCTGATCTACGATACCAGCAAGCTGGCCTCCGGCGTGCCATCTAGATTCAGCGGCTCCGGCTCAGGCACCGACTACACCCTGACA ATCTCCTCTCTGCAGCCCGAGGATGCCGCCACATACTATTGCCAGCAGTGGAGCTCCAATCCTTTCACCTTTGGCCAGGGCACAAAGCTGGAGATCAAG | -1 |
| 223. | 9287 | L1 | SSVSY | S164-Y168 |
| 224. | 9287 | L1 | TCTAGCGTGTCCTAC | -1 |
| 225. | 9287 | L3 | QQWSSNPFT | Q225-T233 |
| 226. | 9287 | L3 | CAGCAGTGGAGCTCCAATCCTTTCACC | -1 |
| 227. | 9287 | L2 | DTS | D186-S188 |
| 228. | 9287 | L2 | GATACCAGC | -1 |
| 229. | 9287 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A261-K370 |
| 230. | 9287 | CH2 | GCGCCACCAGAGGCAGCAGGACCCAGAGCCAAGGGCCCACCGGGCCCCCGTGTTCCTGTTCCCACCCAAGCCCAAGGATACCCTGATGATCAGCCGCACCCCTGAGGTGACATGCGTGGTGGTGAGCCGTGT CCACGAGGACCCAGAGGTGAAGTTTAACTGGTACGTGGATGGCGTGGAGGTGCACAATGCCAAGACAAAGCCTCGGGAGGAGCAGTACAATTCTACCTATAGAGTGG TGAGCGTGCTGACAGTGCTGCACCAGGACTGGCTGAACGGCAAGGAGTATAAGTGCAAGGTGTCCAATAAGGCCCTGCCTGCCCCAATCGAGAAGACCATCTCTAAGG CCAAG | -1 |
| 231. | 9287 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G371-G476 |

| SEQ ID No. | Clone | Description | sequence | |
|---|---|---|---|---|
| 232. | 9287 | CH3 | GGCCAGCCTCCGAACCTCAGGTGTACGTGCTGCCTCCATCTAGAGACGAGCTGACCAAGAACCAGGTGAGCCTGACCTGTCTGGTGAAGGCTTCTATCCAAGCGATATCGCCGTGGAGTGGGAGTCCAATGGGCAGCCCGAGAACAATTACCTGACCTGGCCTGTGCTGGATTCAGATGGCAGCTTCTTTCTGTATTCCAAGCTGACAGTGGATAAGTCTAGGTGGCAGCAGGGCAACGTGTTTTCTTGCAGCGTGATGCACGAGGCCCTGCACAATCACTACACCCAGAAGTCCCTGTCTCTGAGCCCGGC | -1 |
| 233. | 6689 | Full | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDHYCLDYWGQGTTLTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLITVDKSRWQQGNVFSCSVMHEALHNHYTQKSLSLSPG | -1 |
| 234. | 6689 | Full | CAGATCGTCCTGACTCAGAGCCCCGCTATTATGTCCGCCTCTCCTGGAGAAAAGGTCACTATGACTTGTTCCGCCTCTAGTTCCGTCTCCTACATGAACTGGTATCAGCAGAAATCTGGAACAAGTCCCAAGCGATGGATCTACGACACTTCCAAGCTGGCTTCAGGAGTCCCAGCCCACTTTAGGGGCAGTGGATCTGGGACCTCTTACAGCCTCACCATTTCGGGCATGGAGGCAGAAGATGCTGCAACTTACTACTGCCAGCAGTGGAGCAGTAATCCATTCACCTTTGGATGTGGCACAAAGCTGGAGATCAATGGCGGAGGCGCGGCTACACATTCACTCGGTATACCACCAAGCCAACCGGAAGTCAGGTCCAGGGTAGAAACAGAGACAGAGCTAGATCTAGGCCTGATTGGCCTGCAACAACAGAGCCAGTGTTCAAACAGAACTACCCTCCAGAAGTCGCCAGGGCCACATCTGCTGGAATTCAAAATCAGGTCTGTGTTCTGGTCAAAGGATTCTACCCTTTCTCCGGCTCAGAGCCGCTGTCCGACGACGAGAAAACTAATAAGCCCAATTCAAATCAAGAACCAGAACTGACTGGCTGTCCCGGCATCACTGAAAATCTAGGTCTGATGGATAGCTCGGTGAGCACCCGAGATAGCTGATCAGCTGAATTGGCCGTGGCTGTCCCCGGCACAGACTCCGTAAACATGGCAACCCTGGAGGTCTCAGCTGTATGAAAAAACTAAACAGGTAACTCATTGAGCCCGCCAGCCAGCAACACTCAGAGCGAGCTCAGAAAGTGCAGCGAGATGAGCCCAGTGAGCTCTCTCACAAACTCAGGAGAGTGGGTAGCCAGAAGCAAGCGATGGCAGCCTGGAGGAGTACACTGACCAACCCAGCAACACCTCCACAGCTGATGGATGGGCAACCTGGAGCATAATGGCATAAATGTAAGGTCCCCCTAGCCGGCCTCATGCACGACGTCCGTCAGCTGTCAGCTGTTCAGCTGTTCAGCTGATGGGAAGCTCACTGTGTCCTGTCCCTGTCCCATTACGAAGAGAAAGGCCAACAACACATTACTACAGAAGTCGAGATCATTCTTGTCGGAGAAGTGGAGATCAATGGCTCACTATCGGCTCTAAGAACAGAGGGATCTGGGAACAAGATCTCAAATAGTCTGGCCATGCTTATTGCAGGTACCTGGCACAACAAACACAAGCGAAACCGCTGCAAAGATCCCAGCCCTCCGGCAGCTACTCCAGCAAGTCGCTCTGCACCAAGTGATTGTCTTCTTCAGGCTCTCGTCCAGAGCCCGTCCCTTGCAGGAAATGACAGTCCAGGCACAGAACTGGCTCCAGCTCTCTCCGGCCGAGCACCTCCTGCTGCAAGCAACCCGATGGCGATCCTTCTGGCTGACGTCGATAAAAGCCGGTGCAGGGCCGGTTGGCAGCAGGCCAATGTTGTTCAGCTGCGATGGAGAAACCGCTTACGATGTCCGCGTGTTTCAGCTCCACCTGGC | -1 |
| 235. | 6689 | VL | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEIN | Q1-N106 |
| 236. | 6689 | VL | CAGATCGTCCTGACTCAGAGCCCCGCTATTATGTCCGCCTCTCCTGGAGAAAAGGTCACTATGACTTGTTCCGCCTCTAGTTCCGTCTCCTACATGAACTGGTATCAGCAGAAATCTGGAACAAGTCCCAAGCGATGGATCTACGACACTTCCAAGCTGGCTTCAGGAGTCCCAGCCCACTTTAGGGGCAGTGGATCTGGGACCTCTTACAGCCTCACCATTTCGGGCATGGAGGCAGAAGATGCTGCAACTTACTACTGCCAGCAGTGGAGCAGTAATCCATTCACCTTTGGATGTGGCACAAAGCTGGAGATCAAT | -1 |
| 237. | 6689 | L1 | SSVSY | S27-Y31 |
| 238. | 6689 | L1 | AGTTCCGTCTCCTAC | -1 |
| 239. | 6689 | L3 | QQWSSNPFT | Q88-T96 |
| 240. | 6689 | L3 | CAGCAGTGGAGCTCCAACCCATTCACC | -1 |
| 241. | 6689 | L2 | DTS | D49-S51 |
| 242. | 6689 | L2 | GACACTTCC | -1 |
| 243. | 6689 | VH | QVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDHYCLDYWGQGTTLTVSS | Q122-S240 |

TABLE YY-continued

| SEQ ID No. | Clone | Description | Sequence | |
|---|---|---|---|---|
| 244. | 6689 | VH | CAGGTCCAGCTGCAGCAGCGGAGCGGAGCAGAACTGGCTAGAGACCAGGAACTGTCGAAAATGTCATGCAAGGCCAGCGGCTACACATTCACTCGGTATACCATGCATTGGGTGAAACAGAGACCAGGACAGTGTCTGGAGTGATCGGCTACATTAATCCCAGCAGGGGTACACAATTCACAAACTACAAAGAAGTTTAAAGACAAGGCAACCCTGACCACCGATAAGTCTAGTTCAACAGTTCAGCTGAGCTCCCTGACTTCAGAGAGACAGCGCTGTGTACACTATTGCGCACGCTACTATGACGATCACTACTGTCTGGATTATTGGGGCCAGGGAACTACCCTGACCGTGTCTAGT | -1 |
| 245. | 6689 | H1 | GYTFTRYT | G147-T154 |
| 246. | 6689 | H1 | GGCTACACATTCACTCGGTATACC | -1 |
| 247. | 6689 | H3 | ARYYDDHYCLDY | A218-Y229 |
| 248. | 6689 | H3 | GCACGCTACTATGACGATCACTACTGTCTGGATTAT | -1 |
| 249. | 6689 | H2 | INPSRGYT | I172-T179 |
| 250. | 6689 | H2 | ATTAATCCCAGCAGGGGTACACA | -1 |
| 251. | 6689 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A258-K367 |
| 252. | 6689 | CH2 | GCGCCCGAGAGCTGCAGGCGACCAAGCGTGTTCCTGTTCCACCCAAAACCTAAGGATACTCTGATGATTAGCCGAACTCCTGAGGTCACCTGCCTGTGTCGTGAGCGTGTCGTCTGTCCTGACCGTGCTGCACCAGGACTGGCTGAATGGGAAGAGTACAAGTGCAAAGCGTCTGCCGCCCATCGAAAAAACTATCTCAAGGCAAAA | -1 |
| 253. | 6689 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G368-G473 |
| 254. | 6689 | CH3 | GGGCCAGCCTCGCGAACCACAGGTCTACGTGCTGCCCCCGAGAACAATTACCTGACCTGGCCCCCGTGCTGGACTCTGATGGGAGTTTCTTCTGTATTCAAAGCTGACAGTGCGATAAAGCCCGATGGGAGTGCAGCGGCAATGTGTTCAGCTGTTCAGTGATGCACGAGGCCCTGCACAACCATTACACTCAGAAGTCTCTGTCCCTGTCACCTGGC | -1 |
| 255. | 6690 | Full | QIVLTQSPAIMSASPGEKVTMTCSASSSVSYMNWYQQKSGTSPKRWIYDTSKLASGVPAHFRGSGSGTSYSLTISGMEAEDAATYYCQQWSNPFTFGCGTKLEINGGGSGGGSGGGSQVQLQQSGAELARPGASVKMSCKASGYTFTRYTMHWVKQRPGQCLEWIGYINPSRGYTNYNQKFKDKATLTTDK5SSTAYMQLSSLTSEDSAVYYCARYYDDHYSLDYWGQGTTLTVSSAAEPKSSDKTHTCPPCPAPEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 256. | 6690 | Full | CAGATCGTCCTGACTCAGAGCCCCGCTATTATGTCCGCAAGCCCTGGAGAGAAGGTGACTATGACCTGTTCCGCATCAGTTCCGTGTCTTACATGAACTGGTATCAGCAGAAATCTGGAACCTCCCCAAGCGATGGATCTACGACACTATCCAAGCTGGCATCTGGAGTGCCTGCCCACTTCCGAGGCAGCGGCTCTGGAACCAGTTATTCACTGACTATTAGCGGCATGGAGGCCGAAGATGCCGCTACATACTATTGCCAGCAGTGGAGCAACCCTTCCACCTTTGGATGTGGCACAAAGCTCGAGATCAATGGGGAGGCGGAGGCTCCGGAGGAGGAGGTAGCGGTGGAGGCGGATCGCAGGTACAGCTGCAGCAGTCTGGAGCTGAACTGGCTAGACCTGGGGCTAGTGTCAAGATGTCATGCAAGGCTAGCGGCTACACATTCACTCGGTATACCATGCATTGGGTGAAACAGAGACCAGGGCAGGGTCTAGAATGGATAGGCTACATTAATCCCAGCAGGGGCTACACAAACTACAACCAGAAGTTTAAAGACAAGGCAACCCTGACCACCGATAAGTCATCCAGCACCGCCTATATGCAGCTTAGTTCACAGCTGTACTAGTGAAGATAGTGCCGTGTACTATTGCGCACGCTACTATGACGATCACTACTGTCTGGATTATTGGGGCCAGGGAACTACCCTGACCGTCTAGTGCAGCCGAGCCTAAGTCAAGCGACAAGACCCATACATGCCCCCC | -1 |

TABLE YY-continued

| SEQ ID No. | Clone | Description | sequence | |
|---|---|---|---|---|
| 257. | 6690 | VL | CTTGTCCGGCGCCAGAAGCTGCAGGCGGGACCAAGTGTGTTCCTGTTTCCACCCAAACCTAAGGATACTCTGATGATTTCTGAACTCCTGAGGTCACCTGCTGGTCGTGAGCGTGTCCCACGAGGACCCAGAGCTGTCCTGACGTCTGTCAGTTCAACTGGTACGTGAAGTGCATAATGCCAAAACCAAGCCCAGGGAGGAACAGTACAACTCAACTTATCGCGTCGTCTGTTCCGACCACCAGGACAGCCTTCCGAACCACAGGTCTACGTGCTGCTGCCCCGAGACAATGAGGAGTACAACTGTGCCCCGCCCCTATCGAAAAACTATCTCTAAGGCAAAGGACAGCCTCCGAACCACAGGTCTACGTGCTGCTGCCCCGAGACAATTCAGGTCTCTAAAATCAGGTCTCTCTGCTGTCTGTGGGAGTTTCTTTCTGTATTCAAGGATTCTACCCTTCCGACATCGCCGTGGAGTGGGAGAGCAATGGGCAGCCGGAGCAATTACCTGACCTGCCCCGTCCTGGACTCTGATGGGAGTTTCTTTCTGTATTCAAAGCTGACAGTGCGATAAAAGCCGGTGCAGCCGTCAATGTGTTCAGCTGTTCCCTGTCTCCGTCACCTGGC | Q1-N106 |
| 258. | 6690 | VL | QIVLTQSPAIMSASPGEKVTMTCSASSSVSYMNWYQQKSGTSPKRWIYDTSKLASGVPAHRGSGSGTSYSLTISGMEAEDAATYYCQQWSSNPFTFGCGTKLEIN | -1 |
| 259. | 6690 | L1 | CAGATGTCCTGACTCAGAGCCCCGCTATTATGTCCGCAAGCCCTGGAGAGAAAGTGACTATGACCTGTTCCGCATCTAGTTCCGTGTCCTACATGAACTGGTATCAGCAGAAATCTGGAACAAGTCCAAGCGATGGATCTACGACATCCACTTCCAAGCTGGCATCTGGAGTCCCTGCCCACTCCGAGGCAGCGGCTCTGGAACAAGTTATTCACTGACTATTAGCGGCATGGAGGCCGAAGATGCCGCTACATATTATTGCCAACCCCATTCACCTTTGATGTGGCACAAAGCTGGAGATCAAT | S27-Y31 |
| 260. | 6690 | L1 | SSVSY | -1 |
| 261. | 6690 | L3 | AGTTCCGTGTCCTAC | Q88-T96 |
| 262. | 6690 | L3 | QQWSSNPFT | -1 |
| 263. | 6690 | L2 | CAGCAGTGGAGCTCCAACCCCATTCACC | D49-S51 |
| 264. | 6690 | L2 | DTS | -1 |
| 265. | 6690 | VH | GACACTTCC | Q122-S240 |
| 266. | 6690 | VH | QVQLQQSGAELARPGASVKMSCKASGYTFTRYTMHWVKQRPGQCLEMIGYINPSRGYTNYNQKFKDKATLTTDKSSTAYMQLSSLTSEDSAVYYCARYDDHYSLDYWGQGTTLTVSS | -1 |
| 266. | 6690 | VH | CAGGTCCAGCTGCAGCAGTCCGGAGCAGAGAACTGGCTAGAACCAGGAGCCAGTGTGAAAATGTCATGCAAGGCCAGCGGCTACACATTCACTCGGTATACCATGCATTGGGTGAAACAGAGACCAGGACAGTGTCTGGAGTGGATCGGCTACATTAATCCCAGCAGAGGTTACAACAATACAACAGAGAGTTTAAAGACAAGGCAACCCTGACCACCGATAAGTCTAGTTCAACAGTTCAACAGCTTATATGCAGTCCCTGACTTCAGAGGACAGCGCTGTACTATTGCGCACGCTACTATTGACGATCACTACTCCCTGGATTATTGGGGCCAGGGAACTACCCTGACCGTCTAGT | -1 |
| 267. | 6690 | H1 | GYTFTRYT | G147-T154 |
| 268. | 6690 | H1 | GGCTACACATTCACTCGGTATACC | -1 |
| 269. | 6690 | H3 | ARYYDDHYSLDY | A218-Y229 |
| 270. | 6690 | H3 | GCACGCTACTATGACGATCACTACTCCCTGGATTAT | -1 |
| 271. | 6690 | H2 | INPSRGYT | I172-T179 |
| 272. | 6690 | H2 | ATTAATCCCAGCAGGGGTACACA | -1 |

TABLE YY-continued

| SEQ ID No. | Clone | Description | Sequence | |
|---|---|---|---|---|
| 273. | 6690 | CH2 | APEAAGGPSVFLFPPKPKDTLMISRTPEVTCVVVSHEDPEVKFNWYDGVEVHNAKTKPREEQYNSTYRVVSVLTVLHQDWLNGKEYKCKVSNKALPAPIEKTISKAK | A258-K367 |
| 274. | 6690 | CH2 | GCGCCAGAAGCTGCAGGCGGACCAAGTGCAGGTTCAACTGGTACGGTGATGGGGTCGAAGTGCATAATGCCAAAACCAAGCCAAGGAGGAACAGTACAACTCTACCTATCGCGTCGTGTCCGTGCTGACCGTGCTGCACCAGGACTGGCTGAATGGCAAGGAGTACAAATGTAAGGTCTCAAATAAGGCTCTACCCGCCCCCATCGAAAAAACTATCTCTAAGGCAA | -1 |
| 275. | 6690 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G368-G473 |
| 276. | 6690 | CH3 | GGACAGCCTCGCGAACCACAGGTCTACGTGCTGCCCCCTAGCCGCGACGAACTGACTAAAAATCAGGTCTCTCTGCTGTGTCTGGTCAAAGGATTCTACCCTTCGACATCGCCGTGGAGTGGGAAAGTAACGGCCAGCCCGAGAACAATTACCTGACCTGGCCCCCTGTCCTGGACTCTGATGGAGTTCTTTCTGTATTCAAAGCTGACAGTCGATAAAGCCGTGGACAGGGTGGCAGGTGTTCAGCTGCCGTCAGCGAAGAGTCCCTGTCCCTGTCCACCTGGC | -1 |
| 277. | 6691 | Full | DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGCGTKLEIKGGGGSGGGGSGGGGSQVQLQQSGAELVRPGSSVKISCKASGYAFSSYWMNWVKQRPGQCLEWIGQIWPGDGTNYNGKFKGKATILTADESSSTAYMQLSSLLASEDSAVYFCARRETTTVGRYYYAMDYWGQGTTVTVSSAAEPKSSDKTHTCPPCPAPEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 278. | 6691 | Full | GATATTCAGCTGACACAGAGCCCCGCATCCCTGGCCGTGAGCCTGGGACAGCGGGCCACCATTAGCTGCAAGGCCAGCCAGAGTGTAGACTATGATGGAGACAGCTATCTGAACTGGTACCAGCAGATTCCAGGACAGCCTCCGAAGCTGCTGATCTACGACGCCAGCAATCTGGTCTCCGGCATCCCGCCGAGATTTTCTGGCAGTGGCTCTGGCACCGACTTCACCCTGAATATTCACCCGGTCGAGAAAGTGGACGCAGCCACCTATCACTGTCAGCAGAGCACAGAGGATCCGTGGACATTTGGCTGCGGAACAAAACTGGAGATCAAGGGCGGAGGTGGCTCAGGGGGAGGTGGCAGCGGAGGTGGAGGATCACAGGTGCAACTGCAACAATCAGGAGCAGAACTGGTACGGCCTGGCTCCAGCGTGAAGATCTCCTGCAAGGCCAGCGGCTACGCCTTTTCTAGTTACTGGATGAATTGGGTGAAACAGCGGCCCGGACAGTGCCTGGAGTGGATCGGCCAGATTTGGCCTGGAGATGGAACTAATTACAACGGAAAGTTCAAGGGCAAAGCCACAATTCTTACAGCAGATGAATCGTCTCGGCCCTCAACCAGAGGACTCCGCGGTGTATTTCTGCGCCCGTCGAGAGACAACTACAGTGGGACGGTACTACTATGCCATGGACTATTGGGGCCAGGGAACAACAGTGACCGTGTCATCAGCAGCTGAGCCCAAATCTAGCGATAAAACCCACACCTGCCCACCCTGTCCTGCACCAGAAGCCGCTGGCGGACCCTCAGTCTTCCTCTTCCCCCCAAAACCCAAGGACACTCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACTATCTCCAAAGCCAAAGGGCAGCCCCGAGAACCACAGGTGTACACCCTGCCCCCATCCCGGGAGGAGATGACCAAGAACCAGGTCAGCCTGTCTGCCTGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCCCTGCACTGGC | -1 |
| 279. | 6691 | VL | DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGCGTKLEIK | D1-K111 |
| 280. | 6691 | VL | GATATTCAGCTGACACAGAGCCCCGCATCCCTGGCCGTGAGCCTGGGACAGCGGGCCACCATTAGCTGCAAGGCCAGCCAGAGTGTAGACTATGATGGAGACAGCTATCTGAACTGGTACCAGCAGATTCCAGGACAGCCTCCGAAGCTGCTGATCTACGACGCCAGCAATCTGGTCTCCGGCATCCCGCCGAGATTTTCTGGCAGTGGCTCTGGCACCGACTTCACCCTGAATATTCACCCGGTCGAGAAAGTGGACGCAGCCACCTATCACTGTCAGCAGAGCACAGAGGATCCGTGGACATTTGGCTGCGGAACAAAACTGGAAATCAAG | -1 |
| 281. | 6691 | L1 | QSVDYDGDSY | Q27-Y36 |
| 282. | 6691 | L1 | CAGAGCGTGGACTATGATGGAGACAGCTAT | -1 |

TABLE YY-continued

| SEQ ID No. | Clone | Description | sequence | |
|---|---|---|---|---|
| 283. | 6691 | L3 | QQSTEDPWT | Q93-T101 |
| 284. | 6691 | L3 | CAGCAGTCCACAGAGGACCCCTGGACT | -1 |
| 285. | 6691 | L2 | DAS | D54-S56 |
| 286. | 6691 | L2 | GACGCCAGC | -1 |
| 287. | 6691 | VH | QVQLQQSGAELVRPGSSVKISCKASGYAFSSYWMNWVKQRPGQCLEWIGQIWPGDGDTNYNGKFKGKATLTADESSSTAYMQLSSLASEDSAVYFCARRETTVGRYYYAMDYWGQGTTVTVSS | Q127-S250 |
| 288. | 6691 | VH | CAGGTCCAGCTGCAGCAGAGCGGAGCAGAACTGGTCCGACCTGGAAGCTCCGTGAAGATTTCTTGCAAGGCCAGTGGCTATGCTTTTTCTAGTTACTGGATGAATTGGGTGAAGCAGGACCAGGACAGTGTCTGGATGGACAGATTTGGCCTGGAGTGATTGGACAGATTTGGCCTGGGGATGGACAGATTTGGCCTGGAGTCTGTCTAGTCTCGGCTAGTGAGGATTCAGCTGTACTTTTGCGCCCGGGAGAGAAACCACAACTGTGGGCAGATACTATTACGCAATGGACTACTGGGGCCAGGGACCACAGTCACCGTGTCAAGC | -1 |
| 289. | 6691 | H1 | GYAFSSYW | G152-W159 |
| 290. | 6691 | H1 | GGCTATGCTTTTTCTAGTTACTGG | -1 |
| 291. | 6691 | H3 | ARRETTVGRYYYAMDY | A223-Y239 |
| 292. | 6691 | H3 | GCCCGGGAGAGAAACCACAACTGTGGGCAGATACTATTACGCAATGGACTAC | -1 |
| 293. | 6691 | H2 | IWPGDGDT | I177-T184 |
| 294. | 6691 | H2 | ATTTGGCCTGGGGATGGAGACACC | -1 |
| 295. | 6691 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A268-K377 |
| 296. | 6691 | CH2 | GCGCCCAGAGTCGCAGGCGGACCTTCCGGTGTTCCTGTTTCCCGTTGTGAGATCTCTCGCACTCCAGAGGTCACCTGCGTGGTCGTGTCCGTCTCAGGAGGACCCCGAGAACCCGAAGTTCAACTGGTATGTGGACGGGGTCGAAGTGCATAATGCCAAAACAAAGCCAAGCCAAGCAAGCAAGCTCATGCCTGAGGAACAGTATAACTCTACATACCGCGTGTGAGTGTCCTGACTGTGCTGCATCAGGATTGGCTGAATGGCAAGGAGTACAAATGTAAGGTCTCAAATAAGGCTCTGCCCGCCCATCGAAAAAACTATCTCTAAAGCTAA | -1 |
| 297. | 6691 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G378-G483 |
| 298. | 6691 | CH3 | GGCCAGCCTCGCGAACCAGAGTCTACGTGCTGCCACCCAGCGCCGACGAACTGACTAAAAATCAGGTCTCTCTGCTGTGTGCTGGTCAAGGATTCTACCCTTCCGACATCGCCGTGGAGTGGAAAGTAACGGCCAGCCAGAGAACAATTACCTGACCTGGCCCCCTGTCCTGGACTCTGATGGAAGTTCTTTCTGTATTCAAAGCTGACAGTCGATAAAGCCGGTGCAGGGCAATGTGTTCAGCTGCTCCGTCATGCACGAAGCACTGCACAACATTACACTCAGAAGTCCCTGTCCCTGTCACCTGGC | G378-G483 |

TABLE YY-continued

| SEQ ID No. | Clone | Description | sequence | |
|---|---|---|---|---|
| 299. | 6692 | Full | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGCGTKLEIKGGGGS GGGGSGGGGSQVQLQQSGAELVRPGSSVKISCKASGYAFSSYWMNWVKQRPGQCLEWIGQIWPGDTNYNGKFKGKATLTADESSSTAYMQLSSLASEDSAVYFCARRET TTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVV SVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFALVSKLTVDKSRWQ QGNVFSCSVMHEALHNHYTQKSLSLSPG | -1 |
| 300. | 6692 | Full | GACATCCAGTTGACACAGAGCCCCGCCAAGCCTGGCCGTGAGCCTGGGACAGAGAGCCACTATTTCATGCAAAGCTGGGACTATGATGGAGACAGCTATC TGAACTGGTACCAGCAGATCCCAGGCCAGCCCCCTAAACTGCTGATCTACGACGCCAGCAATCTGGTCTCCGGCATCCCACCCAGGTTCAGTGGATCAGGCAGCGGGAC TGATTTTACACTGAACATTCACCCTGTCGAGAAGTGGACGCGCTACCTACTGCTTCTTTCTAGTTACTGACAGTTTGGAGGACGAGAACTTTCGACTGGACACCAAACTGGAAA TCAAGGGCGGAGGCGGGAGCGGAGGAGGAGGCAGTGGCGGCGGAGGCAGCCAGGTGCAGCTGCAACAGAGCGGGCGCAGATTTGGCCTGCGGGA TGGAGACACCAACTATATAATGGCAAGGCAAGCGACACTCTGACCGCCGACGAGAGCAGCACCGCCTACATGCAGCTGAGCAGCCTGGCTGCTGAGGATTCA GCAGTGTACTTTTGCCCCGGAGACACACTATAAGGAGAAAAGCCACAACATCCTGATAAGACACACTCTTCCGCTCCGTCTTCCGTCCCCTAAACCAAGGACGACCTGTGATGATC TCTCGCACTCCAGAGGTCACCTGCCTGCTGTCTCCACAGTCGGCAGTGCTGGCGAGGGGTCGAAGTCAATGGCTCAAAAGCAA AGCCTAGGGAGGAGAAGTATAACTCTGAAAAGACAGCCCTCGCGAACCAGCCTCGCAGCAAAGGACAGCCTCTACGTCTACGTCCGAACCAAGGTATGGTATGAGGTCTCTGG GGTCTCTGACATGCCTGGTCAAAGGATTCTACCCTTCCGACATCGCCGTGGAGTGGGAAAAGTAACGGCCAGCCCAGAACAATTACAAGACCACACCCCCTGTCCTGG ACTCTGATGGGAGTTTCGCTCTGGTGTCAAAGCTGACCGTCGATAAAAGCCGTGGCAGCAGCATGTCTTTAGCTGCTCATGCACGAAGCCCTCACAATCA CTACACCAGAAGTCCCTGAGCCTGGC | -1 |
| 301. | 6692 | VL | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGCGTKLEIK | D1-K111 |
| 302. | 6692 | VL | GACATCCAGTTGACACAGAGCCCCGCCAAGCCTGGCCGTGAGCCTGGGACAGAGAGCCACTATTTCATGCAAAGCTGGGACTATGATGGAGACAGCTATC TGAACTGGTACCAGCAGATCCCAGGCCAGCCCCCTAAACTGCTGATCTACGACGCCAGCAATCTGGTCTCCGGCATCCCACCCAGGTTCAGTGGATCAGGCAGCGGGAC CGATTTTACACTGAACATTCACCCTGTCGAGAAGGTTGACGCGCTACCACTGCTTCCGGCAGTGCCGACTCTGACACTCGACTTTCGACTGGACACCAAACTGGAAA TCAAG | -1 |
| 303. | 6692 | L1 | QSVDYDGDSY | Q27-Y36 |
| 304. | 6692 | L1 | CAGAGCGTGGACTATGATGGAGACAGCTAT | -1 |
| 305. | 6692 | L3 | QQSTEDPWT | Q93-T101 |
| 306. | 6692 | L3 | CAGCAGTCCACAGAGGACCCCTGGACT | -1 |
| 307. | 6692 | L2 | DAS | D54-S56 |
| 308. | 6692 | L2 | GACGCCAGC | -1 |
| 309. | 6692 | VH | QVQLQQSGAELVRPGSSVKISCKASGYAFSSYWMNWVKQRPGQCLEWIGQIWPGDTNYNGKFKGKATLTADESSSTAYMQLSSLASEDSAVYFCARRETTVGRYYYAM DYWGQGTTVTVSS | Q127-S250 |
| 310. | 6692 | VH | CAGGTGCAGCTGCAGCAGAGCGGAGCAGAACTGGTCCGACCTGGAAGCTCCGTGAAGATCTCCTGCAAGGCCAGTGGCTATGCTTTTCTAGTTACTGACAACTCTGACCGC TGAAGCAGCAGCCAGGACAGTGTCTGGAGTGGATCGGACAGATTTGGCCTGGCGATGACAACTATAATGGAAAGTTCAAAGGCAAGGCAACCACACTCTGACACACTCTGCC GACGAATCAAGCTCAACCAGCTTATATGCAGCTTCAGCTGTCTAGTCTGGCTAGTGAGGATTCAGCAGTGTACTTTTGCGCCCGAGAAACCAACTCAGCAGTAGTAGTAAATTA CGCAATGACTACTGGGGCCAGGGGACCACAGTCACCGTGTCAAGC | -1 |

TABLE YY-continued

| SEQ ID No. | Clone | Description | Sequence | |
|---|---|---|---|---|
| 311. | 6692 | H1 | GYAFSSYW | G152-W159 |
| 312. | 6692 | H1 | GGCTATGCTTTTTCTAGTTACTGG | -1 |
| 313. | 6692 | H3 | ARRETTVGRYYYAMDY | A223-Y239 |
| 314. | 6692 | H3 | GCCCGGAGAGAAACCAACTGTGGGCAGATACTATTACGCAATGGACTAC | -1 |
| 315. | 6692 | H2 | IWPGDGDT | I177-T184 |
| 316. | 6692 | H2 | ATTTGGCCTGGGGATGGAGACACC | -1 |
| 317. | 6692 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A268-K377 |
| 318. | 6692 | CH2 | GCGCCAGAAGCTGCAGGCGGACCTTCCGTGTTCCTGTTCCCCCTAAACCAAAGGACACTCTGATGATCTCTCGACTCTGAGAGTCGAGGAGAACAGTGCCAAATAACTCTACATACCGCTGTGAGTGTCCTGACTGTGCTGCATCAGGATTGGCTGAATGGCAAGGAGTACAAATGTAAGGTGAGCAATAAGGCACTGCCCGCCCATCGAAAAAACTATTAGCAAAGCAAAA | -1 |
| 319. | 6692 | CH3 | GQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G378-G483 |
| 320. | 6692 | CH3 | GGACAGCCTCGCGAACCACAGAGTCTACGTCTACCCCAGCCGAGACCTGACCAAGAATCAGGTCTCTCTGACGTGTCTGGTCAAAGGATTCTACCCTTCCGACATCGCCGTGGAGTGGGAAAGTAACGGCCAGCCCGAGAACAATTACAAGACCACACCCCCTGTCCTGGACTCTGATGGGAGTTTCGCTCTGGTGTCCAAGCTGACCGTCGATAAAAGCCGGTGGCAGCAGGGCAATGTGTTTAGCTGCTCCGTGATGCACGAGGCTCTGCACAACCACTACACACAGAAGTCCCTGAGCCTGAGCCCTGGC | -1 |
| 321. | 11175 | Full | DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGL5SPVTKSFNRGEC | -1 |
| 322. | 11175 | Full | GACATTCAGTTGACCCAGAGCCCTTCCTCCCTGAGCGCCAGCGTGGGCGACAGAGCCACCATCACCTGCAGGGCCAGCCAATCGTGGACTACGAGGGCGACTCCTACCTGAACTGGTATCAGCAGAAGCCCGGCAAGGCCCCCAAGCTGCTGATCTACGACGCCTCCAACCTGGTGTCCGGCATCCCTTCCAGGTTTAGCGGCTCCGGCAGCGGCACCGATTTCACCCTGACCATCAGCAGCCTGCAGCCCGAGGACGCCGCCACCTACTACTGCCAGCAGAGCACCGAGGACCCCTGGACCTTCGGCCAGGGCACCAAGCTGGAGATCAAGAGAACAGTGGCCGCCCCCAGCGTGTTCATCTTCCCCCCCCAGCGATGAACAGCTGAAGTCCGGCACAGCAAGCGTGGTGTGCCTGCTGAACAACTTCTACCCCAGGGAAGCCAAGGTGCAGTGGAAAGTGGACAACGCCCTGCAGAGCGGCAACAGCCAGGAGAGCGTCACCGAGCAGGACAGCAAGGACAGCACCTACTCCCTGTCCTCCACACTGACCCTGTCCAAGGCCGATTACGAGAAGCACAAGGTGTACGCCTGCGAGGTGACACACCAGGGCCTGTCTCCCCGTGACCAAGAGCTTCAACAGGGGCGAG | -1 |
| 323. | 11175 | VL | DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIK | D1-K111 |
| 324. | 11175 | VL | GACATTCAGCTGACCCAGAGCCCCTCTCCCTGAGCGCCAGCGTGGGCGACAGGGCCACAATCACCTGTAGAGCCAGCCAATCGTGGACTACGAGGGCGACTCCTACCTGAACTGGTATCAGCAGAAGCCCGGCAAGGCCCCTAAGCTGCTGATCTACGACGCCTCCAACCTGGTGTCCGGCATCCCTTCCAGGTTCAGCGGCTCTGGCAGCGGCACCGATTTCACCCTGACCATCAGCAGCCTGCAGCCCGAGGACGCCGCCACCTACTACTGCCAGCAGAGCACCGAGGACCCCTGGACCTTCGGCCAGGGCACCAAGCTGGAGATCAAG | -1 |
| 325. | 11175 | L1 | QSVDYEGDSY | Q27-Y36 |

TABLE YY-continued

| SEQ ID No. | Clone | Description | Sequence | |
|---|---|---|---|---|
| 326. | 11175 | L1 | CAATCCTGGACTACGAGGGGACTCCTAC | -1 |
| 327. | 11175 | L3 | QQSTEDPWT | Q93-T101 |
| 328. | 11175 | L3 | CAGCAGAGCACCGAGGACCCCTGGACC | -1 |
| 329. | 11175 | L2 | DAS | D54-S56 |
| 330. | 11175 | L2 | GACGCCTCC | -1 |
| 331. | 11175 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R112-C218 |
| 332. | 11175 | CL | AGGACCGTGGCCGCTCCCTCCGTGTTCATCTTCCCCCCAGCGATGAACAGCTGAAGTCCGGCACAGCTTCCGTGGTGTGCCTGCTCAACAACTTCTACCCCAGGAAGC CAAGGTCAGTGGAAGTTGATAACGCCCTGCAGAGCGGCAACTCCCAGGAGTCCGTGACAGAGCAGGACAGCAAGGACAGCACCTACTCCCTGTCCTCCACCCTGACC CTGTCCAAGGCCGATTACGAGAAGCACAAGGTGTACGCCTGCGAGGTGACACACCAGGGCCTTCTCAAGGGCCTTCAAGAGGGCGAGTGC | -1 |
| 333. | 1064 | Full | DIQLTQSPASLAVSLGQRATISCKASQSVDYDGDSYLNWYQQIPGQPPKLLIYDASNLVSGIPPRFSGSGTDFTLNIHPVEKVDAATYHCQQSTEDPWTFGGGTKLEIKGGGG SGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVFCARRE TTTVGRYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTYPPSRDELTKNQVSLTCLVKGFYPSDIAVEWESNGQPENNYKTTPPVLDSDGSFALVSKLTVDKSRW QQGNVFSCSVMHEALHNHYTQKSLSLSPGK | -1 |
| 334. | 1064 | Full | GACATTCAGCTGACACAGAGTCCTGCTTCACTGGCAGTGAGCCTGGACAGAGCCAATATCTCCTGCAAAGCTAGTCAGTCAGTTGACTATGATGGGGACTCTTATCT GAACTGGTACCAGCAGATCCCAGGGCAGCCCCCTAAGCTGCTGATCTACGACGCCTCCAACCTGGTATCCGGCATCCCACCGATTCAGCGCGCTGGCTCTGGACT GATTTTTACCCTGAACATTCACCCAGTTGAGAAGGTGGACGCGCTACCACCATTGCAGTCAGCTGGAATCAGCGAAGCCAGCTGGTGAAATGCAGAGCCTGGAGTC TCAAGGAGGAGGAGGCAGTGGAGGCGGTGGCAGCCAGGTGCAGCTACAGCAGAGCGGCGCTGAAGCTGTCAGAGGCCAGGCTCCCAAAGATTTCGGCCTGGGA TGGAGACACTACTATAATGGAAAGTTCAAAGGCAAGGCTACACTGACTGCAGACGAGAGCTCTAGTACAGCCTACATGCAGCTGAGCAGCCTGGCCTCTGAGGATTCC GCTGTCTTTTGCCACGGAGGAAACAACCACATGGGGCAGTACTATTACGCAATGGACTACTGGGGCCAGGGCACCACAGTGACTGTGTCAGCTGCAGCCGAAC CCAAATCCTCTGATAAGACCCACACAGTGCCCTCATGTCCAGCTGGCCATGAGCACCAGGCCGGTCAGCACAACATTCCCAAAGACCCCAAGATACAAAGGATGGGCCCTCAAGCGAAACCAAG GGCCCTCCAGTCCAGTCAGGGCAACCATTTCCAAGGCTGTGACAACTCCCTGTTCTATATGGCCAGCAGGACCTGTATCATACCAACCAGGTGTAATACAGCTGGGAGAACGCTCAGATAATCAACACCCCTCCAGTGCTGA TTCTGACGGAGTTCTCACTGGTCAGTAAAACTGACAGTGATAAGTCACGGTGGCAGCAGGGAAACGTCTTTAGTTGTTCAGTGATGCACGAGGCCCTGCACAATCAT TACACTCAGAAAAAGCCTGTCCCTGTCTCCCGGCAAG | -1 |
| 335. | 1064 | VL | DIQLTQSPASLAVSLGQRATISCKASQSVDYDGDSYLNWYQQIPGQPPKLLIYDASNLVSGIPPRFSGSGTDFTLNIHPVEKVDAATYHCQQSTEDPWTFGGGTKLEIK | D1-K111 |
| 336. | 1064 | VL | GACATTCAGCTGACACAGAGTCCTGCTTCACTGGCAGTGAGCCTGGACAGAGCCAATATCTCCTGCAAAGCTAGTCAGTCAGTTGACTATGATGGGGACTCTTATCT GAACTGGTACCAGCAGATCCCAGGGCAGCCCCCTAAGCTGCTGATCTACGACGCCTCCAACCTGGTGAGCGGCATTCCACCGCGATTCAGCGGCTCTGGACT GATTTTACCCTGAACATTCACCCAGTTGAGAAGGTGGACGCCGCTACCTACCACTGCCAGCAGTCTACCGAGGACCCCTGGACCTTCGGCGGGGAACTAAACTGAAA TCAAG | -1 |
| 337. | 1064 | L1 | QSVDYDGDSY | Q27-Y36 |

TABLE YY-continued

| SEQ ID No. | Clone | Description | sequence | |
|---|---|---|---|---|
| 338. | 1064 | L1 | CAGTCAGTGGACTATGATGGCGACTCCTAT | -1 |
| 339. | 1064 | L3 | QQSTEDPWT | Q93-T101 |
| 340. | 1064 | L3 | CAGCAGTCTACCGAGGACCCCTGGACA | -1 |
| 341. | 1064 | L2 | DAS | D54-S56 |
| 342. | 1064 | L2 | GACGCCTCA | -1 |
| 343. | 1064 | VH | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS | Q127-S250 |
| 344. | 1064 | VH | CAGGTGCAGCTGCAGCAGAGCGGAGCAGAGCTGGTCAGACCAGGCAGCTCCGTGAAGATTTCCTGTAAGGCATCTGGCTATGCCTTTTCTAGTTACTGGATGAATTGGA TGAAGCAGAGGCCAGGACAGGGCCTGGAATGGATCGGGCAGATTTGGCCCGGGGACACTAATTATAATGGAAAGTTCAAAGGCAAGCTACACTGACTGCA GACGAGTCAAGCTCACCGCTTATATGCAGTCTGTCAGTCTGGCCAGCGAGGATTCCGCGTGTCTACTTTTGCGCACGAGAAACCACAACTGTGGGCAGGTACTATTA CGCAATGGACTACTGGGGCCAGGGGACCACAGTCACCGTGTCAAGC | -1 |
| 345. | 1064 | H1 | GYAFSSYW | G152-W159 |
| 346. | 1064 | H1 | GGCTATGCCTTTTCTAGTTACTGG | -1 |
| 347. | 1064 | H3 | ARRETTTVGRYYYAMDY | A223-Y239 |
| 348. | 1064 | H3 | GCACGAGAGAAACCACAACTGTGGGCAGGTACTATTACGCAATGGACTAC | -1 |
| 349. | 1064 | H2 | IWPGDGDT | I177-T184 |
| 350. | 1064 | H2 | ATTTGGCCCGGGGATGGAGACACT | -1 |
| 351. | 1064 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A268-K377 |
| 352. | 1064 | CH2 | GCACCTGAGCTGCTGGGAGGACCAAGCGTGTTCCTGTTTCCACCTAAACCTAAGGACACCCTGATGATCTCGGACACCCCGAAGTCACTTGTGTGGTCGTGGATGTGAG CCACGAGGACCCTGAAGTCAAATTCAACTGGTACGTGGATGGCGTCGAGGTGCATAATGCCAAAACAAAGCCAAGGGAGGAACAGTATAACTCCACTTACCGCGTCGTG TCTGTCCTGACCGTGCTGCATCAGGACTGGCTGAACGGAAAGGAGTACAAATGCAAGGTGTCCAACAAGGCCCTCCCATGCGAGCTCCGAGAAGACCATTTCCAAAGCTA AG | -1 |
| 353. | 1064 | CH3 | GQPREPQVYTYPPSRDELTKNQVSLTCLVKGFYPSDIAVEWESNGQPENNYKTTPPVLDSDGSFALVSKLTVDKSRMQQGNVFSCSVMHEALHNHYTQKSLSLSPG | G378-G483 |
| 354. | 1064 | CH3 | GGGCAGCCTCGAGAACCACAGGTGTATACATACCCACCCAGCTGACGAGCTGACCAAGAACCAGGTCTCCCTGACATGTCTGGTGAAGGGATTTTATCCTTGATAT TGCCGTGGAGTGGAAAGTAATGGCCAGCCAGGAAACAATTACAAGACTACCCCTCCAGTGCTGGATTCGACGGGAGTTCGCACTGGTCAGTAAACTGACAGTGGAT AAGTCACGGTGCAGCAGGGCAACGTCTTTAGTTGTTCAGTGATGCAGGAAGCTCAGAAAAGCCTGTCCCTGTCTCCGGC | -1 |

| SEQ ID No. | Clone | Description | Sequence | |
|---|---|---|---|---|
| 355. | 1065 | Full | DIKLQQSGAELARPGASVKMSCKTSGYTFTRYTMHWVKQRPGQGLEMIGYINPSRGYTNYNQKFKDKATLTTDKSSSTAYMQLSSLTSEDSAVYYCARYDDHYCLDYWGQG TTLTVSSVEGGSGSGGSGGSGGVDDIQLTQSPAIMSASPGEKVTMTCRASSSVSYMNWYQQKSGTSPKRWIYDTSKVASGVPYRPSGSGSGTSYSLTIISMEAEDAATYYCQ QWSSNPLTFGAGTKLELKAAEPKSSDKTHTCPPCPAPELLGGPSVFLFPPKPKDTLMISRTPEVTCVVVDVSHEDPEVKFNWYDGVEVHNAKTKPREEQYNSTYRVVSVLTVLH QDWLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVF SCSVMHEALHNHYTQKSLSLSPGK | -1 |
| 356. | 1065 | Full | GATATTAAGCTGCAGCAGAGCGGAGCTGAGCTGGACGAGCAGGAGCTGGAGCTGGCACGACAGGAGCTGGAGCTGACAATGCACTGG GTGAAGCAGAGACCAGGACAGGGACTGGAATGGAATCGGAGTTCATGACCAGCTACAAGCACCCTCGACCACCAG ATAAGAGCTCCTCTACCGCTTACATGCAGCTGAGTTCACTGACAAGGTCGGAGGACTCAGCTGTATATTGCGCAAGATATAGCCAGCTATATGAGCAGCTATGTCTGGATTATTGGG GACAGGGCACTACCCTGACTGTCAGCTCCGTGGAAGGAGGCTCCGGAGAAAATGTCATCAGCCAGAGACCAGGACAGGGACTGGAGATGATCGGATATATCAGCCAGTCCCA GCAATTATGTCCGCCTTCCCGAGAGAATGCATCAGGTGCAGAAAGTCACTGCAGTCTAGTTCAGTGCATAGCAGCTACATGGTACACAATTGATCAACTAGGCACTAGCCCCAAGAG ATGGATCTATGACACAAGCAAGGTCGCATCTGGAGTGCCTTATAGGTTCAGTGGGTCCGGAACCGAACAAATGGAGTTCAGCCCCTTATAGGTTCAGTGGGTCCGGAACCA TCAAGCAGACAGCTGAGCTGACGACAACGATCAGCGACAGGTTCCTACACTATTGTCAGCAGTGGACTAACAAATGCCCATATCCCAAAGCTGAACCGTTAGGGCAACTGCCCTGGAACAGTACAAT GTCGTCATCAGCGGCTGACAAGCCAGCCGAGCCAGCAAGGTCCGGGACTGGCAGTCGGAACGGCAGTCGGCAGGAGGAACAGTACAAT AGACATATAGAGTCGTGTCAGCTGAACCTGTCAATCGAGTTGCTATACACTGGAAGTACACTGGCCCCCTGCTCCCCATCATTATGCTCTGCCCCCTGCCCAGACTGAACATCGAGA GGGTTCTACCCATCTGATATTGCTGTGGAGTGGGAAAGTAATGGACAGCCGGAGAACAATAGCCCTGACCTGAGGCTGCCAGGAGTCTAAAACTAAGCAGTCCGCTAGGACTCCTAGACATCTTCTTTCTGTAC AGCAACTGACAGTGACAAGTCCCAGATGGCCAGCAGGGACACGGAGCCCCTGCACAATCATTACACCCCAGAAAAAGCCTGTCCCTGT CTCCCGGCAAG | -1 |
| 357. | 1065 | VH | DIKLQQSGAELARPGASVKMSCKTSGYTFTRYTMHWVKQRPGQGLEMIGYINPSRGYTNYNQKFKDKATLTTDKSSSTAYMQLSSLTSEDSAVYYCARYDDHYCLDYWGQG TTLTVSS | D1-S119 |
| 358. | 1065 | VH | GATATTAAGCTGCAGCAGAGCGGAGCTGAGCTGGACGAGCAGGAGCTGGCACGACAGGAGCTGGAGCTGACAATGCACTGG GTGAAGCAGAGACCAGGACAGGGACTGGAATGGAATCGGAGTTCATGACCAGCTACAAGCACCCTCTCGACCACAT ATAAGAGCTCCTCTACCGCTTACATGCAGCTGAGTTCACTGACAAGGTCGGAGGACTCAGCTGTATATTGCGCAAGATATGATCACTATTGTCTGGATTATTGGG GACAGGGCACTACCCTGACTGTCAGCTCC | -1 |
| 359. | 1065 | H1 | GYTFTRYT | G26-T33 |
| 360. | 1065 | H1 | GGCTACACATTCACTCGGTATACA | -1 |
| 361. | 1065 | H3 | ARYDDHYCLDY | A97-Y108 |
| 362. | 1065 | H3 | GCAAGGTACTATGACCATTATTGTCTGGATTAT | -1 |
| 363. | 1065 | H2 | INPSRGYT | I51-T58 |
| 364. | 1065 | H2 | ATTAACCCTTCCCGAGGCTACACC | -1 |
| 365. | 1065 | VL | DIQLTQSPAIMSASPGEKVTMTCRASSSVSYMNWYQQKSGTSPKRWIYDTSKVASGVPYRPSGSGSGTSYSLTISSMEAEDAATYYCQQWSSNPLTFGAGTKLELK | D138-K243 |
| 366. | 1065 | VL | GATATCCAGCTGACCCAGTCCCCAGCAATTATGTCCGCCTCTCCCGGCGAGAAAGTCACCATGACATGCCGGCCTTCAGTTAGTGAGCTACATGAACTGGTATCAGCA GAAATCAGGACACTAGCCCCAAGAGATGGATCTACGACACCTCCAAGTGCCATCTGGGGTGCCTTATAGGTTCAGGAGGTCAGGAACGGACTGGTAATCCACTGACTTTGGGCCCGGAACCAAACTGAGCTGAAG ATTAGCTCCATGGAGGCAGAGATGCCGCTACCTACTGTCAGCAGTGGTCTAGTAATCCACTGACTTTTGGGCCCGGAACCAAACTGAGCTGAAG | -1 |

TABLE YY-continued

| SEQ ID No. | Clone | Description | Sequence | |
|---|---|---|---|---|
| 367. | 1065 | L1 | SSVSY | S164-Y168 |
| 368. | 1065 | L1 | AGTTCAGTGAGCTAC | -1 |
| 369. | 1065 | L3 | QQWSSNPLT | Q225-T233 |
| 370. | 1065 | L3 | CAGCAGTGGTCTAGTAATCCACTGACT | -1 |
| 371. | 1065 | L2 | DTS | D186-S188 |
| 372. | 1065 | L2 | GACACCTCC | -1 |
| 373. | 1065 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A261-K370 |
| 374. | 1065 | CH2 | GCACCCGAACTGCTGGGGGGACCTAGCGTGTTCCTGTTCCCACCCAAAACCAAAGGATACACTGATGATCAGCCGGACACCTGAGGTCACTTGCGTGGTCGTGGACGTGA GCCACGAGGACCCCGAAGTCAAGTTCAACTGGTACGTGGACGGCGTCGAAGTGCATAATGCTAAGACTAAGCCTAGGGAGGAACAGTACAATAGTACATATAGAGTCG TGTCAGTGCTGACCGTCCTGCATCAGGATTGGCTGAACGGGAAGGAGTACAAATGCAAGGTGTCCAATGCCCTGCCTGCTCCAATCGAGAAGACAATTTCTAAAGC CAAG | -1 |
| 375. | 1065 | CH3 | GQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPG | G371-G476 |
| 376. | 1065 | CH3 | GGCCAGCCCCGAGAACCTCAGGTGTATACACTGCCTCCAAGTCGAGACTGGAGAACAAGAATACATGACCCGAGAACTGACTAAGAATCAGGTGAGCTGCTGTGTGTGAAGGGGTTCTACCCATCTGATAT TGCTGTGGAGTGGGAAAGTAATGACAGCCCGGAGAACAATTATATGACCTGGCCACCAGTCCTGGATCTGGACCAAGCTGGAAATTAATGGCGAGGAG AGTCAGATGGCAGCAGGGCAACGTCTTTAGTTGTTCAGTGATGCACGAGGCCCTGCACAATCATTACACCCAGAAAAGCCTGTCCCTGTCCCCGGC | -1 |
| 377. | 1067 | Full | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGSGG GSGGGGSGVQLQQSGAELARPGASVKMSCKASGYTFTRYTMHWVKQRPGQLEWIGYINPSRGYTNYNQKFKDKATLTTDKSSSTAYMQLSSLTSEDSAVYYCARYYDDHY CLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVFSCS VMHEALHNHYTQKSLSLSPGK | -1 |
| 378. | 1067 | Full | CAGATCGTCCTGACACAGAGCCCAGCAGCCCCGGCAATATGTCAGCAGCCCCGGCGAGAAAGTCACAATGACTTGCTCAGCAAGCTCTCCTGTGAGCTACATGAACTGGTATCAGCA GAAAAGCGGAACCTCCCCCAAGAGATGGATCTACGACACATCCAAGCTGGCTTCTGGAGTGCCTGCACACTTCAGGGGCAGCGGCTTCTGGAACCAGTTACTCACTGACA ATTTCCGGCATGGAGGCTGAAGATGCCACCTACTATTGCCAGCAGTGGAGTTCAAACCCATTCACCTTTGGATCTGGCACCAAGCTGGAAATTAATGGCGAGGAG GCTCCCGAGGAGGAGGGTCTCACACGGCTATACCATGCATTGGGTGAAGCAGAGGCCAGGACAGCTGGAATGGATCGGGTACATTAATCCTAGCCGAGGATACACAAACTAC AACCAGAAGTTTAAAGACAAGGCTACACTGTCTGATTATTGGGGCCAGGGAACCCTGGTCACCGTCTCCCCAGCCAAAACGACACCCCCATCCGTCTTCCCCCTGGCCCCT AGGTACTATGACGATCACTACTGTCTGGATTATTGGGGCCAGGGGACTCTGGTCACCGTCTCCTCAGCCGCCGAACCTAAATCTAGTGACAAGACTCATACCTGCCCCC CTTGTCCAGCACCAGAGCTGCTGGGAGGACCCTCAGTCTTCCTGTTCCCACCAAAACCCAAGGACACCCTCATGATCTCCAAAGGATACCATGCTCAAGGTGGACATCAGCC GACGTCTCACGAGGACCCCGAGGTCAAGTTCAACTGGTACGTGGACGGCGTGGAGGTGCATAATGCCAAGACAAAGCCGCGGGAGGAGCAGTACAACTCCACATACCGTGGTGAGTGTGAGTGCACCTGTGCTGGTGGTGGT GCGTGCGTGTCTGTGCGCTGACCGTCCTGCACCAGGATTGGCTGAATGGCAAGGAGTACAAGTGCAAGGTCTCCAACAAAGCCCTCCCAGCCCCCATCGAGAAAACCATCTCC AAAGCCAAAGGGCAGCCCCGAGAACCAACAGGTGTACACCCTGCCCCCATCCCGGGACGAGCTGACCAAGAACCAGGTCAGTCTGACCTGCCTGGTCAAAGGCTTCTAT CCAAGCGATATTGCTGTGGAGTGGGAATCCAATGGGCAGCCGGAGAACAATTACAAGACAACATGGCCCCCCCGTCCTGGACTCAGATCAGATGGGGCTTCTTCATG | -1 |

TABLE YY-continued

| SEQ ID No. | Clone | Description | sequence | |
|---|---|---|---|---|
| 379. | 1067 | VL | GACTGTGGACAAGTCACGGTGGCAGCAGGAGGGAAACGTCTCTTTAGCTGTCCCGTGATGCATGAGGCCCTGCACAATCATTACCCAGAAATCTCTGAGTCTGTCACCCGGCAAG | Q1-N106 |
| 380. | 1067 | VL | QIVLTQSPAIMSASPGEKVTMTCSASSSVSYMNWYQQKSGTSPKRWIYDTSKLASGVPAHFRGSGSGTSYSLTISGMEAEDAATYYCQWSSNPFTFGSGTKLEIN | -1 |
| 381. | 1067 | L1 | CAGATCGTCCTCACACAGAGCCCAGCAATCATGTCAGCTCAGCAAGTCACAATGACTTGCTCAGCAAGTCTCCTCTGAGCTACATGAACTGGTATCAGCAGAAAGCGGAACCTCCCCCAGAGAATGGATCTACGACACATCCAAGCTGGCTTCTGGAGTGCCTGCACACTTCAGGGGCAGCTGGCTCTGGGACCAGTTATTCACTGACAATTTCCGGCATGGAGGCTGAAGATGCCGCTACCTACTATTGCCAGCAGTGGAGTTCAAACCCATTCACTTTTGGATCTGGCACCAAGCTGGAAATTAAT | S27-Y31 |
| 382. | 1067 | L1 | SSVSY | -1 |
| 383. | 1067 | L3 | TCCTCTGTGAGCTAC | Q88-T96 |
| 384. | 1067 | L3 | QQWSSNPFT | -1 |
| 385. | 1067 | L2 | CAGCAGTGGAGTTCAAACCCATTCACT | D49-S51 |
| 386. | 1067 | L2 | DTS | -1 |
| 387. | 1067 | VH | GACACATCC | Q122-S240 |
| 388. | 1067 | VH | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS | -1 |
| | | | CAGGTCCAGCTGCAGCAGTCCGGAGCTGAGCTGGCACGACCAGGAGCAAGTGTGAAAATGTCCTGTAAGGCCAGCGGCTACACCTTCACACGGTATACCATGCATTGGGTGAAACAGAGACCCGGACAGGGACTGGAATGGATCGGATACATTAATCCTAGCCGAGGATACAACTACAACCAGAAGTTTAAAGACAAGGCTACTCTGACACAGATAAGAGCTCCTCTACCGCCTATATGCAGCTGAGTTCACTGACGTGAGGACAGTGCCGTAGTACTATTGCGCTAGGTACTATGACGATCACTACTGTCTGGATTATTGGGGCCAGGGGACTACCCTGACCGTGAGCTCC | |
| 389. | 1067 | H1 | GYTFTRYT | G147-T154 |
| 390. | 1067 | H3 | GGCTACACCTTCACACGGTATACC | -1 |
| 391. | 1067 | H3 | ARYYDDHYCLDY | A218-Y229 |
| 392. | 1067 | H2 | GCTAGGTACTATGACGATCACTACTGTCTGGATTAT | -1 |
| 393. | 1067 | H2 | INPSRGYT | I172-T179 |
| 394. | 1067 | CH2 | ATTAATCCTAGCCGAGGATACACA | -1 |
| 395. | 1067 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A258-K367 |
| 396. | 1067 | CH2 | GCACCAGAGCTGCTGGGAGGACCCTCAGTGTTCCTGTTTCCACCCAAGCCCAAAGGACACCTGAATGATCCTGGTGGTCTGGACGTGTCTCACGAGGACCCCGAAGTCAAGTTTAACTGGTACGTGGACGGCGTCGAGGTGCATAATGCCAAAACCAAGCCAAGGGAGGAGCAGTACAACTCCACATATGCGTGTGT | -1 |

TABLE YY-continued

| SEQ ID No. | Clone | Description | sequence | |
|---|---|---|---|---|
| | | | GTCTGTCCTGACTGTCTGCTGACCAGGATTGCTGACGGCAAGGAGTACAAATGCAAGGTGAGCAACAAGGCCCTGCCTGCTCCAATCGAGAAGACAATTAGCAAAGCCAAG | |
| 397. | 1067 | CH3 | GQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPG | G368-G473 |
| 398. | 1067 | CH3 | GGGCAGCCCCGAGAACCTCAGGTACACTCTGCCTCCATCTGACGAGCTGACCAAAAACCAGTCAGTCTGCTGTGTCCTGGTTGAAGGGCTTCTATCCAAGCGATATTGCTGTGGAGTGGGAATCCAATGGCCAGCCCGAAAAACAATTACATGACATGGCCCCCCGTGCTCGATAGTGACGGCTCCTTCTTCCTGTATAGTAAACTGACTGTGGACAAGTCACGGTGGCAGCAGGGAAACGTCTTTAGCTGTTCCGTGATGCATGAGGCCCTGCACAATCATTACACCCAGAAATCTCTGAGTCTGTCACCCGGC | -1 |
| 399. | 3357 | Full | DILLLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | -1 |
| 400. | 3357 | Full | GACATCCTGCTGACTCAGAGCCCAGTGATCCTGTCAGTCAGCCCAGGAGAGCGGGTCTCCTTCAGTTGTAGATATGCTAGCGAATCAATCCATCTGGCATTCCATCTGGTTCAGGTGGCTCAGGGAGCGGAACAGAGATTTACTCTGTCCATCAATTCTGTGGAGTCTGAAGACATTGCCGATACTATTCCGGCGTCGATAATACTGCTGAACAGCAGGAGTCCGTGACTAAGGAAAGCGGCAAGTCTTTACCCACCTTCGGAATCAAACTTTACTGAGCTGTGTCTGTCTGATAATCTGCCTGAGGGGAACAGCCCAGTGAAGTCCCATCAGTCGAATGTATAGACCTGGCCACAGACTCGAGAGTGCAGACTTTCTCCATCAATTCTGTGGAGAGCGAAGACATAGCGGACTACTATCTGTCAGCAGAACAGCAACAGCAGATACTGGAGCTGAAA | -1 |
| 401. | 3357 | VL | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK | D1-K107 |
| 402. | 3357 | VL | GACATCCTGCTGACTCAGAGCCCAGTGATCCTGTCAGTCAGCCCAGGAGAGCGGGTCTCCTTCTGTAGAGCCAGTCAGTCAATCGGAACAAATATTCACTGGTACCAGCAGAGACTAACGGCTCCCCCCGCCTTGCTGATTAAGTATGCTAGCGAATCCATCTCTGGTTCAGTGCCAGTCAGTGAACAGATTCACTCTGTCCATCAATTCTGTGGAGAGCGAAGACATAGCGGACTACTATCTGTCAGCAGAACAGCAATAATTGGCCCACAACTTTACTCTGT | -1 |
| 403. | 3357 | L1 | QSIGTN | Q27-N32 |
| 404. | 3357 | L1 | CAGTCAATCGGAACAAAT | -1 |
| 405. | 3357 | L3 | QQNNNWPTT | Q89-T97 |
| 406. | 3357 | L3 | CAGCAGAACAATAACTGGCCCACCACA | -1 |
| 407. | 3357 | L2 | YAS | Y50-S52 |
| 408. | 3357 | L2 | TATGCTAGC | -1 |
| 409. | 3357 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R108-C214 |
| 410. | 3357 | CL | CGAACAGTGGCCGCTCCTTCTGTCTTCATCTTTCCCCCTAGTGACGAACAGCTGAAAAGCGGAACAGCTAGTGTCGTGTGCCTGCTGAATAACTTTTACCCAAGAGAGGCAAAGGTTCAGTGGAAAGTCGATAATGCCCTGCAGTCAGGCAGCAGGAACAGCCAGGAGTCGTGACAGCAGGACAGTCTAAGGATAGTACCTATTCACTGAGTCTCACCTGAGTTGTTCCAAAGCTGATTACGAGAGAACAAAGTGTATGCATGCAGTGTGCGAAAAGAGCTTTAACCGGGAGAGT | -1 |
| 411. | 1842 | Full | DIQLTQSPASLAVSLGQRATISCKASQSVDYDGDSYLNWYQQIPGQPPKLLIYDASNLVSGIPPRFSGSGSGTDFTLNIHPVEKDAATYHCQQSTEDPWTFGGGTKLEIKGGGGSGGGGSGGGGSVQLQQSGAELVRPGSSVKISCKASGYAFSSYWMNWVKQRPGQGLEWIGQIWPGDTNYNGKFKGKATILTADESSSTAYMQLSSLASEDSSAVYFCARRE | -1 |

TABLE YY-continued

| SEQ ID No. | Clone | Description | sequence | |
|---|---|---|---|---|
| | | | TTTTVGRYYYAMDYWGQGTTVTVSSAAEPKSSDKTHTCPPCPAPELLGGPSVFLFPPKPKDTLMISRTPEVTCVVVDVSHEDPEVKFNWYDGVEVHNAKTKPREEQYNSTYRV VSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRW QQGNVFSCSVMHEALHNHYTQKSLSLSPGK | |
| 412. | 1842 | Full | GATATTCAGTGACACAGAGTCCTGCTTCACTGGCAGTCTGGGACAGCGAGCCAACTATCTCCTGCAAAGCTAGTCAGTCAGTGATATGGCGACTCCTATCT GAACTGGTACCAGCAGATCCCAGGGCAGCCCCTAAGCTGCTAGTCAGTAGATTCAGCGGCAGCGGGTCTGGGACT GATTTTACCCTGAACATTCACCCAGTGGAGAAGTTGAGGCTGAAGATTCGGCGGCAACTAAACTGGAAA TCAAGGAGGAGGAGGCAGTGCGCAGGAGGAGGAGGAAGCCAGTGCAGATGCAGAGCTGGTCAGACCCAGAGAGCTCCGTGA AAATTTCCTGTAAGGCATCTGCTATGCCTTTCACTGGTTACTCGATGAATGAGAGGCCAGGACAGGCCTCCACAGCTTATATGCAGCTTATATGCAGCGGGA TGGAGACACCCAACTATATGAAGTTCAAAGGCAAGGCTACAACTGTGGGACGAGAGAAACCACAATGGACAGCCAATGACTACTACCGGGTTCTCACCCTGACAGCCAGAACAGCCGAA GCTGTGTACTTTTGCGCAGCGGAGAGAAACCACAATGGACAGCCAATGACTACTACCCGGGTTCTCACCCTGACAGCCAGCCGAA CCCAAATCCTCTGATAAGACCCACAGTCTGTGGTGCTGTGAGCGACCAAGCTGTTCTCCACCTAAGCGTCGAGGTGCATAATGCAAGTGAGCAACTA TCTCGGACACCCGAAGTCACTTGTGTGTCACTTACCTCCACTGCGGCAACCACCACATGAGACACTGCCAAAATTA AGCCCTAGGGAGGAACAGTATAACTCCAAACGCAAGGCTAAGGCCCAGTCTATGTGTAGTACCAACAAGGAGTGAACCAAAACCA GGTCTCCCCTGACGGGAGTTTCGCACTGTGGTGAGGGATTTTATCCTTCAAGACACTGACATGGTTAAGTCAGTGGGCAGCCAAGTAATTACAAGACTACCCCTCCAGTGCTGG ATTCTGACGGGAGTTTCGCACTGTGGTGAGGGATTTTATCCTTCAAGACACTGACATGGTTAAGTCAGTGGGCAGCCAAGTAATTACAAGACTACCCCTCCAGTGCTGG TTACACCCCAGAAAAGCCCTGTCCCTGTCTCCGGCAAG | -1 |
| 413. | 1842 | VL | DIQLTQSPASLAVSLGQRATISCKASQSVDYDGDSYLNWYQQIPGQPPKLLIYDASNLVSGIPPRFSGSGTDFTLNIHPVEKVDAATYHCQQSTEDPWTFGGGTKLEIK | D1-K111 |
| 414. | 1842 | VL | GATATTCAGTGACACAGAGTCCTGCTTCACTGGCAGTCTGGGACAGCGAGCCAACTATCTCCTGCAAAGCTAGTCAGTCAGTGATATGGCGACTCCTATCT GAACTGGTACCAGCAGATCCCAGGGCAGCCCCTAAGCTGCTGATCTACGACGCCCATCCAACTCTGGTGAGCGGGTCTGGGACT GATTTTACCCTGAACATTCACCCAGTGGAGAAGGTTGAAGCCGCTACCTATTGCCAGCAGAGCACTGAGGACCCCTGGACT TCAAG | -1 |
| 415. | 1842 | L1 | QSVDYDGDSY | Q27-Y36 |
| 416. | 1842 | L1 | CAGTCAGTGACTATGATGGCGACTCCTAT | -1 |
| 417. | 1842 | L3 | QQSTEDPWT | Q93-T101 |
| 418. | 1842 | L3 | CAGCAGTCTACCGAGGACCCCTGGACA | -1 |
| 419. | 1842 | L2 | DAS | D54-S56 |
| 420. | 1842 | L2 | GACGCCCTCA | -1 |
| 421. | 1842 | VH | QVQLQQSGAELVRPGSSVKISCKASGYAFSSYWMNWVKQRPGQGLEWIGQIWPGDGTNYNGKFKGKATLTADESSSTAYMQLSSLASEDSAVYFCARRETTTVGRYYYAM DYWGQGTTVTVSS | Q127-S250 |
| 422. | 1842 | VH | CAGGTGCAGCTGCAGCAGAGCGGAGCAGAGCTGGTCAGACCAGGAAGCTCCGTGAAAATTTCCTGTAAGGCATCTGGCTATGCCTTTCAGTACTACTGGATGAATTGGG TGAAGCAGAGGCCAGGACAGGCCCTGAATGATCGGGCAGATTTGGCCCAGCAGCTTATATGCAGCTGTCAGTCTCAGTCAGCTCAGCTGGGCCAGCAGCAGCTAGTGATGATCATAAATGGGAAGTTCAAGGCAAGGCTACACTGACTGCA GACGAGTCAAGCTCCACAGCTTATATGCAGCTGTCAGTCTCAGTCAGCTCAGCTGGGCCAGCAGCAGCTAGTGATGATCATAAATGGGAAGTTCAAGGCAAGGCTACACTGACTGCA CGCAATGACTACTGGGGCCAGGGGACCACAGTCACCGTGTCAAGC | -1 |

TABLE YY-continued

| SEQ ID No. | Clone | Description | Sequence | |
|---|---|---|---|---|
| 423. | 1842 | H1 | GYAFSSYW | G152-W159 |
| 424. | 1842 | H1 | GGCTATGCCTTTCTAGTTACTGG | -1 |
| 425. | 1842 | H3 | ARRETTVGRYYAMDY | A223-Y239 |
| 426. | 1842 | H3 | GCACGGAGAGAAACCAACTGTGGGCAGTACTATTACGCAATGACTAC | -1 |
| 427. | 1842 | H2 | IWPGDGDT | I177-T184 |
| 428. | 1842 | H2 | ATTTGGCCCGGGATGGAGACACC | -1 |
| 429. | 1842 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A268-K377 |
| 430. | 1842 | CH2 | GCACCTGAGCTGCTGGGAGGACCAAGCGTGTTCCTGTTCCCACCTAAACCTAAGGACACACTGATGATCTCTCGGACACCCGAAGTCACTTGTGTCGTGGATGTGAGCCACGAGGACCCTGAAGTCAAATTCAACTGGTACGTGGATGGCGTTGAGGTGCATAATGCCAAAACTAAGCCTAGGGAGGAACAGTATAACTCCACTTACCGCGTCGTGTCTGTCCTGACCGTCCTGCACCAGGACTGGCTGAACGGAAAGGAGTACAAATGCAAAGGTCTCCATCGAGAAGACAATTTCCAAAGCTAAG | -1 |
| 431. | 1842 | CH3 | GQPREPQVYVPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G378-G483 |
| 432. | 1842 | CH3 | GGCCAGCCTCGAGAACCACAGTCTATGTGCCACCCAGTCTCGGGACGAGCTGACCAAGAACCAGGTCTCCCTGACCTGTCTGGTGAAGGGATTTTATCCTTCTGATATTGCCGTGGAGTGGGAAAGTAATGGCCAGCCAGAAAACAATTACAAGACCACCCCTCCAGTCCTGGATTCTGACGGAAGTTTCGCACTGGTCAGTAAACTGACTGTGGATAAGTCACGGTGGCAGCAGGGAAACGTCTTTAGTTGTTCAGTGATGCACGAGGCCCTGCACAATCATTACACCCAGAAAAGCCTGTCCCTGTCTCCCGGC | -1 |
| 433. | 2227 | Full | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYCLDYWQQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK | -1 |
| 434. | 2227 | Full | CAGATCGTCCTGACACAGTCCCCAGCAATCATGTCAGCCAGCCCTGGGGAGAAAGTCACAATGACTTGCTCAGCAAGTCTCTGTGAGCTACAAGCCTGGGGCAGCACCTCAGGGCAGCATCCAGACCTTCAGGGTGGATCCCTGCGCCCTCCGGAAGATCTGGGACCAGTTATTCACTGACAATTAGCGCGGACCTGAAGATGCCTGAAGATTAAAGCCATCTGAGGTTCAAACCCATTCACTTTTGGATGTGGACACAGTTGGCGGACCTGAAATTAATGCGGAGGAGGCTCCGGAGGAGGACCTACACCTTCACACGGTATACCATGCATTGGGTAAGACAGAGACCATGGTCAGAGCTAGCCAGCCGAAGCAAGTGCGACCAAGACTACCAGGAGAAGCTCTAGCCTCCGACCATCATGATCGGTAGACCAAGAGCTTGGAGCCTCATAAAGACCAAGGCCCTGCGCAGTGTCCAATCGAGACCAATCTGGAAGGAGCACACCTGAGTGGATTGACTGATGATCTCCGGACACTGATGATCTCTGATATATCCACAAGGTCTCACCTGCGGTTCAGGCCAAGAGCTCCAGGAACAATATGCCAATCGAAGCCTCCACAAAGCTCATAAGGCACTCATGATCTCTGGAGGACGAACAACAAGGCTCTGCTCCTGCGGCCAATGTGGCGGACTACCAGTTGCGACTACCAGCCAAGAGGAATTAGCAAGCGGATTGTGGAGTGGGAATCAATGGCCAGCCCCAAAACAATTACCAGTCTCTGCGCCCCTGTCCTGGACTCTGATGGCAGCTTCTTCTGTACGTGTAAACTG | -1 |

TABLE YY-continued

| SEQ ID No. | Clone | Description | Sequence | |
|---|---|---|---|---|
| 435. | 2227 | VL | ACCGTGACAAGTCACGGTGCAGCAGGGGAACGTCTTTAGCTGTGTCCGTGATGCATGAGGCCCTGCACAATCATTACACCCAGAAATCTCTGAGTCTGTCACCCGGCAAG | Q1-N106 |
| 436. | 2227 | VL | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEIN | -1 |
| 437. | 2227 | L1 | CAGATCTGTCTGCACAGTGTCTCAGCAATCATGTCAGCTCCCCAGGAGAAAGTCACAATGACTTGCTCAGCAAGTCTCCTGTGAGCTACATGAACTGGTATCAGCAGAAAAGCGGGACCTCCCCCAAGAGATGGATCTACGACACATCCAAGCTGGCTTCTGGAGTGCCTGCACACTTCAGGGGCAGCTGGGAGTGGAGTCAACTTCAGGGGCAGCTGGGAGTGGAGTCACTGACAATTAGCCGGCATGGAGCTGAAGATGCCGCTACCTACTATTGCCAGCAGTGGAGTTCAAACCCATTCACTTTTGGATGTGGCACCAAGCTGGAAATTAAT | S27-Y31 |
| 438. | 2227 | L1 | SSVSY | -1 |
| 439. | 2227 | L1 | TCCTCTGTGAGCTAC | Q88-T96 |
| 440. | 2227 | L3 | QQWSSNPFT | -1 |
| 441. | 2227 | L3 | CAGCAGTGGAGTTCAAACCCATTCACT | D49-S51 |
| 442. | 2227 | L2 | DTS | -1 |
| 443. | 2227 | L2 | GACACATCC | Q122-S240 |
| 444. | 2227 | VH | QVQLQQSGAELARPGASVKMSCKASGYTFTRYTMHWVKQRPGQCLEMIGYINPSRGYTNYNQKFKDKATLTTDKSSSTAYMQLSLTSEDSAVYYCARYDDHYCLDYWGQGTTLTVSS | -1 |
| 445. | 2227 | VH | CAGGTGCAGCTGCAGCAGTCCGGAGCTGAGCTGGCACGAGCCAGGAGCAAGTGAAAATGTCATGCAAGGCCAGCGGCTACACCTTCACACGGTATACCATGCATTGGGTGAAACAGAGACCCGGACAGTGTCTGGAATGGATCGGCTACATTAATCCTTCGAGGGTACAACTACAATACCAGAGTTAAAGACAAGGCTACTCTGACACAGATAATGCGTAGGTACTATGCGATCTGTCTGATTATTGGGGCCAGGGAACTACCCTGACAGTGAGCTCC | G147-T154 |
| 446. | 2227 | H1 | GYTFTRYT | -1 |
| 447. | 2227 | H1 | GGCTACACCTTCACACGGTATACC | A218-Y229 |
| 448. | 2227 | H3 | ARYYDDHYCLDY | -1 |
| 449. | 2227 | H3 | GCTAGGTACTATGACGATCACTACTGTCTGGATTAT | I172-T179 |
| 450. | 2227 | H2 | INPSRGYT | -1 |
| 451. | 2227 | H2 | ATTAATCCTTCTCGAGGGTACACA | A258-K367 |
| 452. | 2227 | CH2 | APELLGGPSVFLFPPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | -1 |
| 453. | 2227 | CH2 | GCACCAGAGCTGCTGGGAGGACCGTCTGTTCCTGTTCCCACCCAAGGATACTCTGATGATCTCCAGGACCCCTGAAGTCACTTGCGTGGTGGTGGACGTGTCTCACGAGGACCCCGAAGTCAAGTTTAACTGGTACGTGGACGGCGTCGAGGTGCATAATGCCAAAACCAAGCCACGGGAAGAACAGTACAACTCCACATATCGCGTGT | |

TABLE YY-continued

| SEQ ID No. | Clone | Description | Sequence | |
|---|---|---|---|---|
| 453. | 2227 | CH3 | GTCTGTCCTGACTGTCTGCTGCCAGGATTGCTGTGACGGAGAAAGGAGTGAACAATGACAAGCCCCTGCCTGTCCAATCGAGAAGACAATTAGCAAGCCAAG | G368-G473 |
| 454. | 2227 | CH3 | GQPREPQVYVLPPSRDELTKNQVSLLCLVKGFYPSDIAVEWESNGQPENNYLITWPPVLDSDGSFFLYSKLTVDKSRWQQGNVFSCSVMHEALHNHYTQKSLSLSPG | -1 |
| 455. | 2228 | Full | GGCCAGCCCCGAGAACCTCAGTGCTGCCTGCTGTGAAGGACTAAAAACCAGTGACTGAGCTGACTTGGCCCCTGTCCAGATGGCAGCTTCTTTCTGTATAGTAAACTGACCGTGGACAAGTCACGGTGGCAGGGGAACGTCTTTAGCTGTTCCGTGATGCATGAGGCCCTGCACAATCATTACACCCAGAAATCTCTAGTCTGTCACCCGGC | -1 |
| 456. | 2228 | Full | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGSGGGGSGQVQLQQSGAELARPGASVKMSCKASGYTFTRYTMHWVKQRPGQCLEWIGYINPSRGYTNYNQKFKDKATLTTDK5SSTAYMQLSLITSEDSAVYYCARYYDDHYSLDYWQGFTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK | -1 |
| 457. | 2228 | Full | CAGATCGTCCTGACACAGAGCCCAGCAATCATGTCAGCAGCCCCAAGAGAGAAGTCACAATGACTTGCTCAGCAAGCTCCTCTGTGAGTACAATGAACTGGTATCAGCAGAAAAGCGGGACCTCCCCCAAGAGATGGATCTACGACACATCCAAGCTGGCACAGTGCCAAGCTTCAGGGGGCCAAGCCACACCATCTCAAACCCATTCTGGAATGGAGGCGGAAGCTGAGGACGCTGCCACCTACTACTGCCAGCAGTGGAGTAGCAACCCATTCACCTTTGGATGTGGCACCAAGCTGGAAATCAACGGTGGAGGCGGTTCAGGCGGAGGTGGCTCTGGCGGTGGCGGATCGGAGATCGTGCTGACCCAGAGCCCTGCCACCCTGTCTCTGAGCCCAGGGGAGCGGGCCACCCTCTCCTGCAGGGCCAGTCAGAGTGTTAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGTGGCAGTGGGTCTGGGACAGACTTCACTCTCACCATCAGCAGCCTAGAGCCTGAAGATTTTGCAGTGTATTACTGTCAGCAGCGTAGCAACTGGCCGATCACCTTCGGCCAAGGGACACGACTGGAGATTAAA | Q1-N106 |
| 458. | 2228 | VL | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEIN | -1 |
| 459. | 2228 | VL | CAGATCGTCCTGACACAGAGCCCAGCAATCATGTCAGCAGCCCCAAGAGAGAAGTCACAATGACTTGCTCAGCAAGCTCCTCTGTGAGTACAATGAACTGGTATCAGCAGAAAAGCGGGACCTCCCCCAAGAGATGGATCTACGACACATCCAAGCTGGCCTCAGGAGTTCCAGCGCAGCGGCCAGTGGATCTGGGACCTCTTACTCACTCACCATTAGCGGCATGGAGGCTGAAGATGCTGCCACTTATTACTGCCAGCAGTGGAGTAGTAACCCATTCACTTTTGGATGTGGCACCAAGCTGGAAATTAAT | S27-Y31 |
| 460. | 2228 | L1 | SSVSY | -1 |
| 461. | 2228 | L1 | TCCTCTGTGAGCTAC | Q88-T96 |
| 462. | 2228 | L3 | QQWSSNPFT | -1 |
| 463. | 2228 | L3 | CAGCAGTGGAGTTCAAACCCATTCACT | D49-S51 |
| 464. | 2228 | L2 | DTS | -1 |
| 465. | 2228 | L2 | GACACATCC | |

TABLE YY-continued

| SEQ ID No. | Clone | Description | sequence | |
|---|---|---|---|---|
| 465. | 2228 | VH | QVQLQQSGAELARPGASVKMSCKASGYTFTRYTMHWVKQRPGQCLEMIGYINPSRGYTNNQKFKDKATLTTDKSSTAYMQLSSLTSEDSAVYYCARYDDHYSLDYWGGGTTLTVSS | Q122-S240 |
| 466. | 2228 | VH | CAGGTCAGCTGCAGCAGTCCGGAGCTGAGCTGGCACGACAGGAGCAAGTTGAAACAGAGACCCCTCTACCGCATATGACAGCTGAGTTCACTGACATCTAGCCAGGTACAAATGTCATGCAAGGCCAGGCTACACCTTCACACGGTATACCATGCATTGGGTGAAACAGAGACCCGGACAGTGTCTGGAATGATCGGCTACATTAATCCTAGCCGAGGTTACAAACACAGAAGTTCAAAGACTACTGCAGGACAACTACTCCCTGATTATTGGGGGCCAGGGAACTACCCTGACAGTGAGCTCC | -1 |
| 467. | 2228 | H1 | GYTFTRYT | G147-T154 |
| 468. | 2228 | H1 | GGCTACACCTTCACACGGTATACC | -1 |
| 469. | 2228 | H3 | ARYYDDHYSLDY | A218-Y229 |
| 470. | 2228 | H3 | GCTAGGTACTATGACGATCACTACTCCCTGGATTAT | -1 |
| 471. | 2228 | H2 | INPSRGYT | I172-T179 |
| 472. | 2228 | H2 | ATTAATCCTAGCCGAGGTACACA | -1 |
| 473. | 2228 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A258-K367 |
| 474. | 2228 | CH2 | GCACCAGAGCTGCTGGGCGGACCCTCTGTGTTCCTGTTTCCACCCAAACCAAAGGATACTCTGATGATCTCCCGGACACCTGAAGTCACTTGTGTGGTGGTGGACGTGTCTCACGAGGACCCCGAAGTCAAGTTTAACTGGTACGTGGACGGCGTCGAGGTGCATAATGCCAAAACCAAGCCAAGGGAGGAACAGTACAACTCCACATATCGCGTGTGTCTGTCCTGCACCAGGATTGGCTGAACGGAAAGGAGTACAAATGCAAGGTGAGCAACAAGGCCCTGCCTGCCATCGAGAAGACAATTAGCAAGCCAAG | -1 |
| 475. | 2228 | CH3 | GQPREPQVYVLPPSRDELTKNQVSLLCLVKGFYPSDIAVEWESNGQPENNYLTWPVLDSDGSFFLYSKLTVDKSRWQQGNVFSCSVMHEALHNHYTQKSLSLSPG | G368-G473 |
| 476. | 2228 | CH3 | GGCCAGCCCCGAGAACCTCAGGTGCTACGTGCTGCCTCCATCTCGGGACGAGCTGACTAAAAACCAGGTCAGTCTGCTCTGCCTGGTGAAGGGATTCTATCCAAGCGATATTGCTGTGGAGTGGGAATCGAATGGCCAGCCCGAAAACAATTACCTGACTTGGCCCGTCCTGGACTCAGATGGCAGCTTCTTCTTGTATAGTAAACTGACCGTGGACAAGTCACGGTGGCAGCAGGGAACGTCTTTAGCTGTTCCGTGATGCATGAGGCCCTGCACAATCATTACACCCAGAAATCTCGAGTCTGTCACCCGC | -1 |
| 477. | 1844 | Full | DIQLTQSPASLAVSLGQRATISCKASQSVDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSVQLQQSGAELVRPGSSVKISCKASGYAFSSYWMNWVKQRPGQGLEWIGQIWPGDGDTNYNGKFKGKATLTADESSSTAYMQLSSLASEDSAVIFCARRETTTVGRYRYYAMDYWGQTTVTVSSAAEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDIAVEWESNGQPENNYKTTPPVLDSDGSFALVSKLTVDKSRWQQGNVFSCSVMHEALHNHYTQKSLSLSPGK | -1 |
| 478. | 1844 | Full | GATATTCAGCTGACACAGAGTCCTGCATCACTGGCTGTGAGCCTGGACAGCAGGGCAACTATCTCCTGCAAAGCCAGTCAGTCAGTGATGGCGACTCCTATCTGAACTGGTACCAGCAGATCCCAGGGCAGCCCCCCAAGCTCCTGATCTACGACGCGCTACCACGCCTCAAATCTGGTGAGCGGCATCCCACCACGATTCAGCGGCAGCGGCTCTGGGACTGATTTACCCTGAACATTCACCCAGTCGAGAAGGTGACAGCCGCTACCTACCGGAGGAGAGCAGAGCGCTGTCAGCTGCAGCAGTCTACCGAGGACCCTTGGACCTTCGGCGGGGGAACCAAGCTGGAAATCAAAGGCGGCGGCGGAAGCGGCGGCGGCGGAAGCGGAGGCGGAGGATCAGTGCAGCTGCAGCAGTCTGGGGCCGAGCTGGTGAGGCCTGGGTCCTCAGTGAAGATTTCCTGTAAGGCTTCTGGCTATGCATTTTCTAGTTACTGGATGAATTGGGTGAAGCAGAGGCCAGGACAGGGTCTAGAATGGATTGGACAAATTTGGCCCGGGGA | -1 |

TABLE YY-continued

| SEQ ID No. | Clone | Description | sequence | | |
|---|---|---|---|---|---|
| 479. | 1844 | VL | TGGAGACACCAACTAATAATGGAAAGTTCAAAGGCAAGGCCACACTGACTGCTGACAGAGTCAAGCTCCACAGCCTCAAGCTGTCTAGTCTGGCAAGCGAGGATTCC GCCGTGTACTTTTGCCTCGAGAGAAACCCACACTGGGACGAAGCCTATGACTATACGCTAGGAGGACCACAGTCACCGTGTCAAGCGCAGCCGAAC CAAATCTCAGACACCCGAAGTGCACTTGTGTCGTGAGCCACAGCAGCTCCCCATGTGCAGTCCCCTGTTTCCTGTTTCCCCTAAACCTAAGGACACACTGATGATCT CTCGGACACCCGAAGTGCACTTGTGTCGTGAGCCACAGCAGCTCCCCTGAAGTCAATTCAACTGTACGTGGATGGCGTCGAGTGCATAATGCAAACTAA GCCTAGGGAGGAGAACAGTATAACTCCACTTACCGCGTCGTGTCTGACCGTGCTCCTGACCGTGCTGCTGACTGTGCATCAGGACGAGTACAACAGCGAGCTGAACAAG GTCTCCCTGACATGTCTGGTGAAGGAATTTATCCTTGATAATTCGCTGAGTGGAGTGGGAAAGTAATTGCCCAGAAAACAATTACAAGACTACCCCTCCAGTGCTGA TTCTGACGGAGTTTCCTCTTGGTCAGTAAAACTGACTGTGATAAGTCACGTGGCAGCAGGAAATGTCTTAGTTGTTCAGTGATGCACGAGGACCTAAACTGAAA ACACCCAGAAAGCCTGTCCCTGTCTCCCGGCAAG | DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK | D1-K111 |
| 480. | 1844 | VL | GATATTCAGCTGACACAGAGTCCTGCATCACTGGCTGTGAGCCTGGGACAGCGAGCAACTATCTCCTGCAAAGCCAGTCAGTGGACTATGATGGCGACTCCTATCT GAACTGGTACCAGCAGATCCCAGGGCAGCCCCCTAAGCTGCTCAGTCTGGATGAGCCGTCAAATCTGGTTGAGCGGCAGCGCGTCTGGGACT GATTTTACCCTGACACATTCACCCAGTCGAGAAGGTGACGCCGCTACCTACCAGTCACCATTGCCAGCAGTCAACGCCCCTGACATTGCCAGCAGTACCGGGGAACTAAACTGAAA TCAAG | | -1 |
| 481. | 1844 | L1 | CAGTCAGTGGACTATGATGGCGACTCCTAT | QSVDYDGDSY | Q27-Y36 |
| 482. | 1844 | L1 | | | -1 |
| 483. | 1844 | L3 | CAGCAGTCTACCGAGGACCCCTGGACA | QQSTEDPWT | Q93-T101 |
| 484. | 1844 | L3 | | | -1 |
| 485. | 1844 | L2 | GACGCCTCA | DAS | D54-S56 |
| 486. | 1844 | L2 | | | -1 |
| 487. | 1844 | VH | CAGGTGCAGCTGCAGCAGAGCGGAGCAGAGCTGGTCAGACCAGGAGCTCCGTGAAGATTTCCTGCAAGGCTTCTGGCTATGCATTTTCTAGTTACTGGATGAATTGG TGAAGCAGAGGCCAGGACAGGGCCTGGAATGATCGGGCAGATTTGGCCCGGGATGGAAGATCCGAGACACTATAATGGAAAAGTTCAAAGGCAAGGCCACACTGACTGCT GACGAGGACTCAAGCACAGCTACGTGCTCAGCTGTCTAGTCTCAGTCGCAGAGGATTCCGCCGTCGAGAGAAACCACACTGTGGGCGGTCAGGTACTATTA CGCTATGGACTACTGGGGCCAGGGGACCACAGTCACCGTGTCAAGC | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAM DYWGQGTTVTVSS | Q127-S250 |
| 488. | 1844 | VH | | | -1 |
| 489. | 1844 | H1 | GGCTATGCATTTTCTAGTTACTGG | GYAFSSYW | G152-W159 |
| 490. | 1844 | H1 | | | -1 |
| 491. | 1844 | H3 | GCTCGGAGAGAAACCACAACTGTGGGCAGGTACTATTACGCTATGGACTAC | ARRETTTVGRYYYAMDY | A223-Y239 |
| 492. | 1844 | H3 | | | -1 |

TABLE YY-continued

| SEQ ID No. | Clone | Description | Sequence | |
|---|---|---|---|---|
| 493. | 1844 | H2 | IWPGDGT | I177-T184 |
| 494. | 1844 | H2 | ATTTGGCCCGGGGATGAGACACC | -1 |
| 495. | 1844 | CH2 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A268-K377 |
| 496. | 1844 | CH2 | GCTCCTGAGGCTGCAGGAGGACCAAGGTGCTGTTCCTGTTCCCCCTAAACCTAAGGACACACTGATGATCTCCGGACACCCGAAGTCACTGTTGTGTGTGGATGTGAG CCACGAGGACCCTGAAGTCAATTCAACTGGTACGTGGATGGCGTGGAGGTGCATAATGCCAAAACTAAGCCTAGGGAGGAGCAGTATAACTCCACTTACCGCGTGTG TCTGTCCTGACCGTGCTGCATCAGGACTGGCTGAACCGTGAACCGAAAGGAGTACAAATGCAAGGTGAGCAACAAGGCACTGCCAGCCCATCGAGAAGACAATTTCCAAAGCA AAG | -1 |
| 497. | 1844 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G378-G483 |
| 498. | 1844 | CH3 | GGCCAGCCTCTGAGAACCTGTATGTGTACCACCCAGTCTCTATGTGTACCACCCAGCCGGGACGAGCTCGGGACCTGACCAAAAACCAGTCTCCCCTGGTTGAAGGATTTTATCCTTCTGATAT TGCCGTGGAGTGGGAAAGTAATGGCCAGCCAGAGAACAATTACAAGACTACACCCCAGTCTCTGGATTCTGACGGAGTTTCGCTCTGTCAGTAAACTGACTGTGAT AAGTCACGGTGCAGCAGGGAAACGTCTTTTAGTGTTCAGTATGCAGCGGAAACGTCTCTTTAGTGTTCAGTATGCAGCACTGCACAATCATTACACCCAGAAAAGCCTGTCCCTGTCCTGTCCTGTCCCTGGC | -1 |
| 499. | 9284 | Full | QVQLVQSGGGVVQPGRSLRLSCKASGYTFTRYTMHWVRQAPGKGLEWIGYINPSRGYTNYNQKVKGRFTISTDKSKNTAYLQMDSLRAEDTGVYFCARYDDHYSLDYWGQ GTLVTVSSVEGGSGGSGGSGGSGGVDDIQMTQSPSSLSASVGDRVTITCSASSSVSYMNWYQQKPGKAPKRWIYDTSKLASGVPSRFSGSGSGTDYTLTISSLQPEDAATYYCQ QWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLH QDWLNGKEYKCKVSNKALPAPIEKTISKAKGQPREPQVYTLPPSRDELTKNQVSLTCLVKGFYPSDIAVEWESNGQPENNYLTWPPVLDSDGSFFLYSKLTVDKSRWQQGNVFS CSVMHEALHNHYTQKSLSLSPG | -1 |
| 500. | 9284 | Full | CAGGTGCAGCTGGTGCAGAGCGGAGAGCGGAGGAGTGGTGCAGCCAGGCCGGTCTCTGAGACTGTCTTGTAAGGCCAGCGGCTACACCTTCACAAGGTATACCATGCACTGG GTGCGCCAGGCACCAGGAAAAGGTCTAAGAATACCGCCTAAGGAATACCGCCTAAGGAAATACCGGCTACAGAGGGCTACACAAATATAATCCAAGAGGGGGCTACACAAATATAATCCAAGAGGGG GACAAGGTCTAAGAATACCGCCTAAGGAATACCGCCTAAGGAATACCGGCTACAGAGGGCTACACAAATATAATCCAAGAGGGG GACACAGGAATACCGCCTAAGGAATACCGGCTACAGAGGGCTACACAAATATAATCCAAGAGGGG CCTTCTAGCCTGCCCTGTGCCGACAAGGTGACCATCACATGTAGCGCCTCTTCTAGCAGTGTATATCGAACTGGATATGAATATGATCAGATGACCCAGAGC GCGGTGGATCTACGATACCAGCAAGCTGGCCTCCGGCGTGCCATCCAGCACCAGGGAGCTCTAAATCCTTCACCCTGCAGGCCAGGGAAAGCTGGAGCTCAATCTGCCCGCGCACTGAGGATCAAGGCTGGGATGACAT GCGTGGTGCAGCGTTCCACCAAGCTGTCCCCAGAGCAAGGGCCACCTACGTGACCAAGGCAACAAGGCCACCTGATGACAACTGAGATGACGTGACAT AACTCTACCTATAGAGTGGTGACGGTGACCAAGGCCGTCTGAGCGTGACCAAGGGCCGTCTGAGCGTGACCAAGGCCGTCTGAGCGTGACCAAGGCCGTCTGAGCGTGACCAAGGCCGTCTGAGCGTGACCAAGGCCGTCCCAATCG AGAAGACCATTCTAAGGCACAAGGCCGTCTAAGGCACAAGGCCGTCTAAGGCACAAGGCCGTCTAAGGCACAAGGCCGTCTAAGGCACAAGGCCGTCTGAGCCTGTGCCTGGT GAAGGGCTTCTATCCAAGCGATATCGCAGTGGAGTGGAGAGTCCAATGGGCAGCGTGTTTTCTTCCTGCAGCGTGACTGATGCAGCAGTCCCTGTCT TGTATTCCAAGCTGACGTGGATAAGTCTAGGTGGCAGGGCAACGTGTTTTCTTGTAGCGTGATGCACGAGGCCCTGCACAATCACTACACCCAGAGTCCCTGTCT CTGAGCCCCGGC | -1 |
| 501. | 9284 | VH | QVQLVQSGGGVVQPGRSLRLSCKASGYTFTRYTMHWVRQAPGKGLEWIGYINPSRGYTNYNQKVKGRFTISTDKSKNTAYLQMDSLRAEDTGVYFCARYDDHYSLDYWGQ GTLVTVSS | Q1-S119 |
| 502. | 9284 | VH | CAGGTGCAGCTGGTGCAGAGCGGAGGAGGAGTGGTGCAGCCAGGCCGGTCTCTGAGACTGTCTTGTAAGGCCAGCGGCTACACCTTCACAAGGTATACCATGCACTGG GTGCGCCAGGCACCAGGAAAAGGTCTGGAATGGATCGGCTACATCAACCCTAGCAGGGGCTACACAAATATAATCAGAAGGTGAAGGGCCGCTTCACAATCAGCACA GACAAGTCTAAGAATACCGCCTATCTGCAGATGACCTCCAGGGCCGAGGATACCGGCGTGTATTTCTGCGCCCGCTACTATGACGATCACTACAGCCTGGATTATTG GGGCCAGGGCACCCTGGTGACAGTGAGCTCC | -1 |

TABLE YY-continued

| SEQ ID No. | Clone | Description | Sequence | |
|---|---|---|---|---|
| 503. | 9284 | H1 | GYTFTRYT | G26-T33 |
| 504. | 9284 | H1 | GGCTACACCTTCACAAGGTATACC | -1 |
| 505. | 9284 | H3 | ARYYDDHYSLDY | A97-Y108 |
| 506. | 9284 | H3 | GCCCGCTACTATGACGATCACTACAGCCTGGATTAT | -1 |
| 507. | 9284 | H2 | INPSRGYT | I51-T58 |
| 508. | 9284 | H2 | ATCAACCCTAGCAGGGGCTACACA | -1 |
| 509. | 9284 | VL | DIQMTQSPSSLSASVGDRVTITCSASSSVSYMNWYQQKPGKAPKRWIYDTSKLASGVPSRPSGSGSGTDYTLTISSLQPEDAATYYCQQWSSNPFTFGQGTKLEIK | D138-K243 |
| 510. | 9284 | VL | GATATCCAGATGACCCAGAGCCCTTCTAGCCTGTCCGCCTCTGTGGGCGACCAGGTGACCATCACATGTAGCGCCTCCTCTAGCGTGTCCTACATGAACTGGTATCAGCAGAAGCCAGGCAAGGCCCCCAAGCGGTGGATCTACGATACCAGCAAGCTGGCCTCCGGCGTGCCATCTAGATTCAGCGGCTCTGGCAGCGGCACCGACTATACCCTGACAATCTCCTCTCTGCAGCCCGAGGATGCCGCCACATATTACTGCCAGCAGTGGAGCAGTAATCCTTTCACCTTTGGCCAGGGCACAAAGCTGGAGATCAAG | -1 |
| 511. | 9284 | L1 | SSVSY | S164-Y168 |
| 512. | 9284 | L1 | TCTAGCGTGTCCTAC | -1 |
| 513. | 9284 | L3 | QQWSSNPFT | Q225-T233 |
| 514. | 9284 | L3 | CAGCAGTGGAGCTCCAATCCTTTCACC | -1 |
| 515. | 9284 | L2 | DTS | D186-S188 |
| 516. | 9284 | L2 | GATACCAGC | -1 |
| 517. | 9284 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A261-K370 |
| 518. | 9284 | CH2 | GCGCCAGAGGCCAGCAGGAGGCCAGCAGGAGACCCAGAGGTGACGTTTAACTGGTACGTGGATGGCGTGGAGGTGCACAATGCCAAGACAAAGCCCAGGGAGGAGCAGTACAACAGCACCTATAGAGTGGTGAGCGTGCTGACAGTGCTGCACCAGGACTGGCTGAATGGCAAAGAGTATAAGTGCAAGGTGTCCAATAAGGCCCTGCCCGCCCCAATCGAGAAGACCATCTCTAAGGCCAAG | -1 |
| 519. | 9284 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G371-G476 |
| 520. | 9284 | CH3 | GGCCAGCCTCGGGAACCTCAGGTGACGTGCTGCCTCCATCCAGAGACGAGCTGACAAAGAACCAGGTGAGCCTGCTGTGCCTGGTGAAGGGCTTCTATCCAAGCGATATCGCCGTGGAGTGGGAGTCCAATGGCCAGCCCGAGAACAATTACTTGACCTGGCCTCCTGATGCAGCTCTTCTGTATTCCAAGCTGACAGTGGATAAGTCTAGGTGGCAGCAGGGCAACGTGTTTTCTTGCAGCGTGATGCACGAGGCACTACACCACCAGAAGTCCCTGTCTCTGAGCCCGGC | -1 |

TABLE YY-continued

| SEQ ID No. | Clone | Description | sequence | |
|---|---|---|---|---|
| 521. | 9285 | Full | QVQLVQSGGGVVQPGRSLRLSCKASGYTFTRYTMHWVRQAPGKGLEWIGYINPSRGYTNYNQKVKGRFTISTDKSNTAYLQMDSLRAEDTGVYFCARYDDHYSLDYWGQ GTLVTVSSVEGGSGGSGGSGGVDDIQMTQSPSSLSASVGDRVTITCSASSSVSYMNWYQQKPGKAPKRLIYDTSKLASGVPSRFSGSGSGTDYLTISLQPEDAATYYCQQ WSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQ DWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCS VMHEALHNHYTQKSLSLSPG | -1 |
| 522. | 9285 | Full | CAGGTGCAGCTGGTGCAGAGCGGAGGAGAGTGGTGCAGCCAGGCCGGTCCTGTAAGGCTGTCTTGTAAGGCCAGCGGCTACACCTTCACAGGCTGG GTGCGCCAGGCACCAGGAAATACCGCCTACTCGCAGATGGACTGGAGTGGATCGGCTACATCAACCCTAGCAGGGGCTACACAAACTATAATCAGAAGGTGAAGGGCCGCTTCACCATCTCCACA GACAAGTCTAAGAATACCGCCTACCTGCAGATGGACAGCCTGAGGGCTGAGGACACCGGGGTGTATTTTTGCGCCAGGTACGATGACCATTATTAC CCCTTCTAGCCTTGACGATATCCGCCTCTGGGCCACAGGGTGACACCGTGACCGTGAGCAGCGAGCTCGGGGAGGGAGGCTCCGGGGGCAGGCTGTGACGTGACGCCTAGGAAGCCCAA CCTCCAGGGCACCCCTCGGACACCAAGTGGCCTCCGGGTGGATCTCCGAGATATCAGCCCCATCACATCGAGTACCCGCCGACCAGGCAGCCCAA CGGCCAGGGCACCCCTCTGCCAGGGACCAAGTGACCGTGAGCAGCGAGCTCGGGGAGGGAGGCTCCGGGGGCAGGCTGTGACGTGACGCCTAGGAAGCCCAA CACATGCCCACCGTGCCCAGCACCTGAACTCCTGGGGGGACCGTCAGTCTTCCTCTTCCCCCCAAAACCCAAGGACACCCTCATGATCTCCCGGACCC CTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCG CGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCC CTCCCAGCCCCCATCGAGAAAACCATCTCCAAAGCCAAAGGGCAGCCCCGAGAACCACAGGTGTACACCCTGCCCCCATCCCGGGATGAGCTGACCAAGAACCAGGTCAGCCTGACCTGCCTGGTCAAAGGCTTCTATC CCAGCGACATCGCCGTGGAGTGGGAGAGCAATGGGCAGCCGGAGAACAACTACAAGACCACGCCTCCCGTGCTGGACTCCGACGGCTCCTTCTTC CTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCT CTGAGCCCCGGC | -1 |
| 523. | 9285 | VH | QVQLVQSGGGVVQPGRSLRLSCKASGYTFTRYTMHWVRQAPGKGLEWIGYINPSRGYTNYNQKVKGRFTISTDKSNTAYLQMDSLRAEDTGVYFCARYDDHYSLDYWGQ GTLVTVSS | Q1-S119 |
| 524. | 9285 | VH | CAGGTGCAGCTGGTGCAGAGCGGAGGAGGAGTGGTGCAGCCAGGCCGGTCCCTGAGACTGTCTTGTAAGGCCAGCGGCTACACCTTCACAGGCTGG GTGCGCCAGGCACCAGGAAATACCGCCTACTCACACACAGATGGACTGGAGTGGATCGGCTACATCAACCCTAGCAGGGGCTACACAAACTATAATCAGAAGGTGAAGGGCCGCTTCACCATCTCCACA GACAAGTCTAAGAATACCGCCTACCTGCAGATGGACAGCCTGAGGGCTGAGGACACCGGGGTGTATTTTTGCGCCAGGTACGATGACCATTATTAC GGGCCAGGGCACCCTGGTGACCGTGAGCTCC | -1 |
| 525. | 9285 | H1 | GYTFTRYT | G26-T33 |
| 526. | 9285 | H1 | GGCTACACCTTCACAAGGTATACC | -1 |
| 527. | 9285 | H3 | ARYYDDHYSLDY | A97-Y108 |
| 528. | 9285 | H3 | GCCCGCTACTATGACGATCACTACAGCCTGGATTAT | -1 |
| 529. | 9285 | H2 | INPSRGYT | I51-T58 |
| 530. | 9285 | H2 | ATCAACCCTAGCAGGGGCTACACA | -1 |
| 531. | 9285 | VL | DIQMTQSPSSLSASVGDRVTITCSASSSVSYMNWYQQKPGKAPKRLIYDTSKLASGVPSRFSGSGSGTDYLTISLQPEDAATYYCQQWSSNPFTFGQGTKLEIK | D138-K243 |
| 532. | 9285 | VL | GATATCCAGATGACCCAGAGCCCCTTCTGTCCGCCTCTGTGGCGACCAGGGTGACCATCACATGTAGCGCCTCCTCTAGCGTGTCCTACATGAACTGGTATCAGCA GAAGCCAGGCAAGGCCCCCAAGCGGCTGATCTACGATACAAGCAAGCTGGCCTCCGGCGTGCCATCTAGATTCAGCGGCTCGGACTCAGTGGCACCGACTATACCCTGACA ATCTCCCTCTGCAGCCCGAGGATGCCGCCACATATTACTGCCAGCAGTGGAGCTCCAATCCTTTCACCTTTGGCCAGGCACAAAGCTGGAGATCAAG | -1 |

TABLE YY-continued

| SEQ ID No. | Clone | Description | sequence | |
|---|---|---|---|---|
| 533. | 9285 | L1 | SSVSY | S164-Y168 |
| 534. | 9285 | L1 | TCTAGCGTGTCCTAC | -1 |
| 535. | 9285 | L3 | QQWSSNPFT | Q225-T233 |
| 536. | 9285 | L3 | CAGCAGTGGAGCTCCAATCCTTTCACC | -1 |
| 537. | 9285 | L2 | DTS | D186-S188 |
| 538. | 9285 | L2 | GATACCAGC | -1 |
| 539. | 9285 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A261-K370 |
| 540. | 9285 | CH2 | GCGCCAGAGGCAGCAGGAGGACCCTCCGTGTTCCTGTTTCCACCCAAGCCAAGGACACTCTGATGATCAGCCGACACCCCTGAGGTGACATGCGTGGTGGTGAGCGTGTCCCACGAGGACCCAGAGGTGAAGTTTAACTGGTACGTGGATGGCGTGGAGGTGCACAATGCCAAGACAAAGCCTCGGGAGGAGCAGTACAACTCTACATATAGAGTGGTGAGCGTGCTGACAGTGCTGCACCAGGACTGGCTGAACGGCAAGGAGTATAAGTGCAAGGTCTCCAATAAGGCCCTGCCCGCCCCAATCGAGAAGACCATCTCTAAGGCCAAG | -1 |
| 541. | 9285 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G371-G476 |
| 542. | 9285 | CH3 | GGCCAGCCTCGCGAACCTCAGGTGTACGTGCTGCCTCCAGCCAGCCGGGACGAGCTGACCAAGAACCAGGTGAGCCTCTGCTGTGTGAAGGGCTTCTATCCAAGCGATATCGCCGTGGAGTGGGAGTCCAATGGCCAGCCCGAGAACAATTACCTGACCTGGCCTCCTGTGCTGGACTCAGATGGCAGCTTCTTTCTGTATTCCAAGCTGACAGTGGATAAGTCTAGGTGGCAGCAGGGCAACGTGTTCTCTTGCAGCGTGATGCACGAGGCCCTGCACAATCACTACACCCAGAAGTCCCTGTCTCTGAGCCCCGGC | -1 |
| 543. | 9286 | Full | QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYDDHYSLDYWGQGTLVTVSSVEGGSGGSGGSGGSGGVDIQMTQSPSSLSASVGDRVTITCSASSSVSYMNWYQQKPGKAPKRWIYDTSKLASGVPSRFSGSGSGTDYTLTISSLQPEDAATYYCQQWSSNPFTPGQGTKLEIKAAEPKSSDKTHTCPPCPAPEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 544. | 9286 | Full | CAGGTGCAGCTGGTGCAGAGCGGAGGAGGAGTGGTGCAGCCAGGCCGGTCTCTGAGACTGTCTTGTAAGGCTAGCGGCTACACCTTCACACGGTATACCATGCACTGGGTGCGCCAGGCACCAGGGAAGGGCCTTCACTGGATTATTGGACAAACTCTAAGAATACCCGCTACAACCTGAGAGTCACAGATGAATCCGCTACTATGAAGAGGTGAAGGGCCGTCACCATCAGCACCGATAACAGCAAGAACACCGCCTACCTGCAGATGGACAGCCTGAGAGCTGAGGACACCGGCGTGTACTTCTGTGCCAGAGCCCTTCTAGCCTGTCTGGGCGACAGGGTGACACTGTATCAGCAGAGCGCGGTGGATCTAGCACAGGTGGGTGCTACAGGTGGCGGTGGATCCGGAGGTGGCGGATCAGGAGGTGGCGGATCAGGTGGTGGCGGATCAGGCGGAGGCGGTGGCGGATCAGGGTGGTGGAGGCGGCGGAGGCGGATCAGGTGGCGGAGGAAGTGGCGGAGGGGTGGACATCCAGATGACCCAGAGCCCCTCTAGCCTGAGCGCCTCCGTGGGCGACAGAGTGACAATCACATGTAGCGCCTCTAGCAGCGTGTCCTACATGAATTGGTACCAGCAGAAGCCCGGCAAAGCTCCCAAGAGATGGATCTACGATACCAGCAAACTCGCCAGCGGGGTGCCCAGCAGATTCAGCGGCAGCGGCTCTGGCACCGACTACACCCTGACAATCAGCAGCCTGCAGCCCGAGGACGCCGCCACCTATTACTGTCAGCAGTGGAGCTCCAATCCTTTCACCTTCGGCCAGGGCACCAAGCTGGAGATCAAAGCGGCTGAGCCCAAGAGCAGCGACAAGACCCACACATGTCCCACCGTGTCCCACAGACCCCCTGAAGCTAGCAGAGGTCCTTCAGTCTTCCTGTTTCCTCCTAAACCAAAGGATACCCTCATGATTAGCCGAACACCGGAGGTCACATGCGTGGTGGTGGACGTTAGCCATGAAGATCCCGAGGTCAAGTTCAACTGGTATGTAGATGGCGTCGAGGTGCACAATGCCAAGACAAAGCCTCGGGAGGAGCAGTACAATTCTACCTATAGAGTGGTGAGCGTGCTGACAGTGCTGCACCAGGACTGGCTGAACGGCAAGGAGTATAAGTGCAAGGTGTCCAATAAGGCCCTGCCTGCCCCAATCG | -1 |

TABLE YY-continued

| SEQ ID No. | Clone | Description | Sequence | |
|---|---|---|---|---|
| 545. | 9286 | VH | AGAAGACCATCTCTAAGGCCAAGGGCCAGCTCTGCCGAACCTCAGGTGTACGTGCTGCCTCCATCTAGAGACGAGCTGACAAAGAACCAGTGACTGAGCCTGTGTCCTGGT GAAGGGCTTCTATCCAAGCGATATCGCCGTGGAGTGGGAGTCCAATGGCCAGCCCGAGAACAATTACCTGACCTGGCCCCCGTGCTGGACTCTGATGCAGCTTCTTC TGTATTCCAAGCTGACAGTGGATAAGTCTAGGTGGCAGCAGGGCAACGTGTTTTCTTGCAGCGTGATGCACGAGGCCCTGCACAATCACTACACCCAGAAGTCCCTGTCT CTGAGCCCCGGC | Q1-S119 |
| 546. | 9286 | VH | QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYDDHYSLDYWGQ GTLVTVSS | -1 |
| 547. | 9286 | H1 | CAGGTGCAGCTGGTGCAGAGCGGAGGAGGAGTGGTGCAGCCAGGCCGGTCCAGGCTCCGGCTACACCTTCACAAGGTATACCATGCACTGG GTGCGCCAGGCACCAGGGAAGGGACTGGAGTGGATCGGCTACATCAACCCTAGCAGGGGCTACACAACTATAATCAGAAGGTGAAGGGCCGCTTCACCATCTCCACA GACAACTCTAAGAATACCGCCTACCTGCAGATGGACTCCCTGAGGGCCGAGGATACAGGCGTGTATTTTGCCCGCTACTACGATGACCACTACAGCCTGGATTATTG GGGCCAGGGCACCCTGGTGACAGTGAGCTCC | G26-T33 |
| 548. | 9286 | H1 | GYTFTRYT | -1 |
| 549. | 9286 | H1 | GGCTACACCTTCACAAGGTATACC | A97-Y108 |
| 550. | 9286 | H3 | ARYYDDHYSLDY | -1 |
| 551. | 9286 | H3 | GCCCGCTACTATGACGATCACTACAGCCTGGATTAT | I51-T58 |
| 552. | 9286 | H2 | INPSRGYT | -1 |
| 553. | 9286 | H2 | ATCAACCCTAGCAGGGGCTACACA | D138-K243 |
| 554. | 9286 | VL | DIQMTQSPSSLSASVGDRVTITCSASSSVSYMNWYQQKPGHAPKRWIYDTSKLASGVPSRFSGSGSGTDYLTISSLQPEDAATYYCQQWSSNPFTFGQGTKLEIK | -1 |
| | | | GATATCCAGATGACCCAGAGCCCTTCTAGCCTGTCCGCCTCTGTGGGCGACAGGGTGACCATCACATGTAGCGCCTCCTCTAGCGTGTCCTACATGAACTGGTATCAGCA GAAGCCAGGCAAGGCCCCCAAGCGGTGGATCTACGATACCAGCAAGCTGGCCTCCGGCGTGCCATCTAGATTCAGCGGCTCTGGCAGCGGCACCGACTATACCCTGACA ATCTCCTCTCTGCAGCCCGAGGATGCCGCCACATACTATTGCCAGCAGTGGAGCTCCAATCCTTTCACCTTTGGCCAGGGCACAAAGCTGGAGATCAAG | |
| 555. | 9286 | L1 | SSVSY | S164-Y168 |
| 556. | 9286 | L1 | TCTAGCGTGTCCTAC | -1 |
| 557. | 9286 | L3 | QQWSSNPFT | Q225-T233 |
| 558. | 9286 | L3 | CAGCAGTGGAGCTCCAATCCTTTCACC | -1 |
| 559. | 9286 | L2 | DTS | D186-S188 |
| 560. | 9286 | L2 | GATACCAGC | -1 |
| 561. | 9286 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A261-K370 |

TABLE YY-continued

| SEQ ID No. | Clone | Description | sequence | |
|---|---|---|---|---|
| 562. | 9286 | CH2 | GCGCCAGAGGCAGCAGGAGGACCTTCCGTGTTCCTGTTCCACCCAAGCCAAAGGATCAATCAGCCACCCTGAGGTGACATGCGTGGTGAGCGTGT CCCAGGAGGACCCAGAGGTGAAGTTCAACTGTACGTGGATGGCGTGGAGGTGCACAATGCCAAGACCAAGCCTCGGGAGGAGCAGTACAATTCTACTATAGAGTGG TGAGCTGCTGACAGTGCTCACCAGGACTGCTGAACGGCAAGGAGTATAAGTGCAAGGTGTCCAATAAGGCCCTGCCCGCCCAATCGAGAGACCATCTCTAAGG CCAAG | -1 |
| 563. | 9286 | CH3 | GQPREPQVYVLPPSRDELTKNQVSLLCLVKGFYPSDIAVEWESNGQPENNYLTWPPVLDSGSFFLYSKLTVDKSRMQQGNVFSCSVMHEALHNHYTQKSLSLSPG | G371-G476 |
| 564. | 9286 | CH3 | GGCCAGCCCCGCGAACCTCAGGTGTACGTGCTTCCATCCAGAGACGAGCTGACAAAGAACCAGGTGAGCCTGCTGTGCCTGGTGAAGGGCTTCTATCCAAGCGATA TCGCCGTGGAGTGGGAGTCCAATGGCCAGCCCGAGAACAATTACCTGACCTGGCCCCCTGTCTGATGCAGCTTCTCTGATGCAGCAGCTGACAGTGGAT AAGTCTAGGTGGCAGCAGGGCAACGTCTTTTCTTGCAGCGTGATGCATGAGGCCCTGCACAATCACTACACCCAGAAGTCCCTGTCTCTGAGCCCGGC | -1 |
| 565. | 7239 | Full | DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIKGGGGS GGGGSGGGGSQVQLVQSGAEVKKPGASVKISCKASGYAFSSYWMNWVRQAPGQCLEWIGQIWPGDTNYAQKFQGRATLTADESTSTAYMELSSLRSEDTAVYYCARRE TTTVGRYRYYAMDYWGQGTTVTVSSEPKSSDKTHTCPPCPAPEAAGGPSVFLFPPKPKDTLMISRTPEVTCVVVSHEDPEVKFNWYVDGVEHNAKTKPREEQYNSTYRVVS VLTVLHQDWLNGKEYKCKVSNKALPAPIEKTISKAKGQPREPQVYVLPPSRDELTKNQVSLTCLVKGFYPSDIAVEWESNGQPENNYKTTPPVLDSDGSFALVSKLTVDKSRWQ QGNVFSCSVMHEALHNHYTQKSLSLSPG | -1 |
| 566. | 7239 | Full | GATATTCAGCTGACCCAGAGCCCAAGCTCCCTGTCTGCCAGTGTGGGGGATAGGGCTACACATTGCCCGCGCATCACAGAGCGTGGACTATGAGGGCGATTCCTATC TGAACTGGTACCAGCAGAAGCCAGGGAAAGCTCCTAAGCTGCTGATCTACGACGCCTCAAACCTGGTGAGTGGGATCCCAAGCAGGTTCTCCGGATCTGGCAGTGGAC ACACTTTACCCTGACAATCTCTAGTGCAGCCCGAGGATGCCGCTACTACTGCCAGCAGAGTACAGAAGACCCTTGGACTTTCGGATGTGCACAAACTGAAGATTGAGA TTAAGGAGGAGGAGGGAGGCAGTGGCGGAGGTCAGGAGGTCAGCAAGCCTGCTGCGGCAGTCAACTGGATATCCAAGACCAGATTGCATGGCAGCTG AAAATTCCTGAGGATACCAATTACGCTCAGAAGTTCAGGGACGCAACTCTCCCAAGGAGATAGAAAGCACAATCTATTGCCCACCAGTGCATATATGCTGAGTGAGCAATGGATCA ACGGAGTACTATTGCCCACGAGAGAAACACAACTTGTCGTCTGTCCAGCCTTGTTCCTGTTTCCACCCAAGCCAAAGTAAACCCTGATGATCAGCCG GCTCCGACAAGACCCATACACTCACCTGTGTCGTGGTGTCCACGGTGGTGCATGACCCTGAAGTGCGTCGAAGTGCATAATGCTAAGACAAAGCCCG AGAGGAACAGTATAACCTGAAAAGACCATTTCGAAGGCAACAGACCATTTCGTCTACCCGTGGAGTGGGAATGCAGCCATTGCCGAGTGGAGTGGGAATGCAGCAATTACAAGACTACCCCGCGCCCGGAGACAGTGAGCAGCTTGTCTTCTCTGTGGTGTCAGTAAGTCAAGATGCGAATAAGTCAAGATGCACGGAGAATGTCTTTTAGTGTTTGTCGTGATGCGAGCACTGCAAGACAAGATGGAACTGGAGACCCAGAGTAAGACCACGCTCAAGCCACTGCACAACCACTAC ACCCAGAAGTCACTGTCCCCTGTCACCCGGC | -1 |
| 567. | 7239 | VL | DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIK | D1-K111 |
| 568. | 7239 | VL | GATATTCAGCTGACCCAGAGCCCAAGCTCCCTGTCTGCCAGTGTGGGGGATAGGGCTACAATCACTTGCCGCGCATCACAGAGCGTGGACTATGAGGGCGATTCCTATC TGAACTGGTACCAGCAGAAGCCAGGGAAAGCTCCTAAGCTGCTGATCTACGACGCCTCTAATCTGGTGAGTGGCATTCCCTCAAGGTTCTCCGGATCTGGCAGTGGAC TGACTTTACCCTGACAATCTCTAGTGTGCAGCCCGAGGATGCCGCTACTATTGCCAGCAGAGTACAGAAGACCCCTGGACTTTCGGACTGTGCACCAAACTGGAGA TTAAG | -1 |
| 569. | 7239 | L1 | QSVDYEGDSY | Q27-Y36 |
| 570. | 7239 | L1 | CAGAGCGTGGACTATGAGGGCGATTCCTAT | -1 |
| 571. | 7239 | L3 | QQSTEDPWT | Q93-T101 |
| 572. | 7239 | L3 | CAGCAGTCTACAGAAGACCCCTTGGACT | -1 |

TABLE YY-continued

| SEQ ID No. | Clone | Description | Sequence | |
|---|---|---|---|---|
| 573. | 7239 | L2 | DAS | D54-S56 |
| 574. | 7239 | L2 | GACGCCTCT | -1 |
| 575. | 7239 | VH | QVQLVQSGAEVKKPGASVKISCKASGYAFSSYWMNWVRQAPGQCLEWIGQIWPGDGTNYAQKFQGRATLTADESTSTAYMELSLRSEDTAVYYCARRETTVGRYYYAMDYWGQGTTVTVSS | Q127-S250 |
| 576. | 7239 | VH | CAGGTCCAGCTGGTGCAGAGCGGAGCAGAGGTCAAGAAGCCAGGCGAGTCTGGAATGATCGACAGATTTGGCTCGGACACAGTGTTCTGAGAAGTTTCAGGGACGCGAACTCTGACCGCGGATGAGGCAGGCACCAGACCTGCGAAGCAGTCTCTGCCTGCGAAGACACAGCCGTCGTACTATTGCGCACGGAGAAACCAACTGTGGGCCGTATATTACGCAATGGATTACTGGGGACCAGGGGACCACAGTCACTGTGAGTTCA | -1 |
| 577. | 7239 | H1 | GYAFSSYW | G152-W159 |
| 578. | 7239 | H1 | GGCTATGCTTTCTCAAGCTACTGG | -1 |
| 579. | 7239 | H3 | ARRETTVGRYYYAMDY | A223-Y239 |
| 580. | 7239 | H3 | GCACGGAGAAACCAACTGTGGGCCGTATATTACGCAATGGATTAC | -1 |
| 581. | 7239 | H2 | IWPGDGDT | I177-T184 |
| 582. | 7239 | H2 | ATTTGGCCTGGGACGGAGATACC | -1 |
| 583. | 7239 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A266-K375 |
| 584. | 7239 | CH2 | GCGCCAGAAGCAGCCGGAGGGCCTAGCGTGTTCCTGTTTCCACCCAAGCCCAAGGATACCCTGATGATCAGCAGGACTCCTGAGGTCACCTGCGTGGTCGTGTCCGTGTCTCACGAGGACCCCGAGAGTCAACTCCAATCAGGACAAAACCCCGAGAGAACAGTATAACTCCACTTACCGGGTGCGTCTGTCCTGACAGTGCTGCATCAGGAGTCCAGGAGTGAGCAACGAGAAGTGCAAAGTACAACAAGGCCCTGCCCCCCCAATCGAAAAGACCATTTCCAAGGCCAAA | -1 |
| 585. | 7239 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G376-G481 |
| 586. | 7239 | CH3 | GGGCAGCCTCGCGAACCTCAGGTCTACGTGCTACCCCTCCATCTAGGGATGACCTCAAGAACCAGGTCAGTCTGACTTGTCTGTGAAGGGCTTCTACCCAAGCGACATTGCCGTGGAGTGGGAATCCAGCCCAGACAATTACAAGACTACACCACCCGTGCTGCTGGACAGCGATGGGTCCTTCGCTCTGGTCAGTAAACTGACAGTGGATAAGTCAAGATGGCAGCAGGGAAATGTCTTTAGTTGTTCAGTGATGCACGAGGCACTGCACCACCACTACACCCAGAAGTCACTCTGTCCCTGTCACCCGGC | -1 |
| 587. | 9288 | Full | QVQLVQSGAEVKKPGASVKISCKASGYAFSSYWMNWVRQAPGQCLEWIGQIWPGDGTNYAQKFQGRATLTADESTSTAYMELSLRSEDTAVYYCARRETTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | -1 |

TABLE YY-continued

| SEQ ID No. | Clone | Description | Sequence | |
|---|---|---|---|---|
| 588. | 9288 | Full | CAGGTCCAGCTGGTGCAGAGCGGAGCAGAGGTGAAGAAGCCAGGTGAAGATCTCCTGCAAGGCCTCTGGCTATGCCTTCAGCTCCTACTGGATGAACTGG GTGCGGCAGGCCACCTGAGCTCTGGAGTGGATCGGACAGATCTGGCCAGGCGATCAAATTATGCGCAAGGACTTCAGGGCAGACTTGACCTGCC GACGAGAGCACATCCACCGCCTAGCCTGGAGCGGATACCTGAGGGTGCTGAGGAACAGAGACCACAACCGTGGGCGCCTACTAT TACGCCATGGACTATTGGGGCCAGGGCACACCGTCACCGTCTCCTCAGCAGCTTCCCACCAAGGGCCCATCGGTCTTCCCCCTGGCACCCTCCTCCAAG GAACCTGCCGCCTGCCTGTATTCTGGAAGGATTACTTCCCAGAACCCGGTGACCGTGTCGTGGAACTCAGGCGCCCTGACCAGCGGCGTGCACACCTTCCCGGCTGT GCAGTCTAGCGCCTGTCCTGTCCAGCAGTCCTCAGGACTCTACACCTCACCAGCGAAGACCCACAAGTTGGACAAGAAACATCCAATACCAAGGT CGACAAGAAGTTGAGCCCCAAAGTCTTGTGATAAGACACACATGCCCACCGTGCCCAGCACCTGAACTCCTGGGGGGACCGTCAGTCTTCCTCTTCCCCCCAAAACCT AAGGACACACTCATGATCTCCAGGACCCCTGAGGTCACATGCGTGGTGGTGGACGTGAGCCACGAAGACCCTGAGGTCAAGTTCAACTGGTACGTGGACGGCGTGGAG GTGCACAATGCCAAGACAAGCCGCGGGAGGAGCAGTACAACAGCACGTACCGTGTGGTCAGCGTCCTCACCGTCCTGCACCAGGATTGGCTGAATGGCAAGGAGTAC AAGTGCAAGGTCGCAATAAGAAAGCCCTCCCAGCCCCCATCGAGAAAACCATCTCCAAAGCCAAAGGGCAGCCCCGAGAACCACAGGTGTACACCCTGCCCCCATCCAGAG ACGAGCTGACCAAGAACCAGGTCAGCCTGACCTGCCTGGTCAAAGGCTTCTATCCCAGCGATATCGCCGTGGAGTGGGAGAGCAATGGGCAGCCGGAGAACAACTACAA GACAACCCCCGTGCTGGACTCCGATGGCTCTTCGCCCTGCTACAGCAAGCTCACCGTGGACAAGAGCAGGTGGCAGCAGGGGAACGTCTTCTCATGCTCCGTGATGC ACGAGGCACTACACAATCACTACACGCAGAAGTCACTGTCACTGTCCCCAGGC | -1 |
| 589. | 9288 | VH | QVQLVQSGAEVKKPGASVKISCKASGYAFSSYWMNWVRQAPGQCLEWIGQIWPGDGDTNYAQKFQGRATLTADESTSTAYMELSSLRSEDTAVYYCARRETTTVGRYYYAM DYWGQGTTVTVSS | Q1-S124 |
| 590. | 9288 | VH | CAGGTCCAGCTGGTGCAGAGCGGAGCAGAGGTGAAGAAGCCAGGTGCAGATCTCCTGCAAGGCCTCTGGCTATGCCTTCAGCTCCTACTGGATGAACTGG GTGCGGCAGGCCACCTGGGCAGGGCCTGGAGTGGATCGGACAGATCTGGCCAGGCGATGATCAAATTATGCGCAAGGACTTCAGGGCAGACTTGACCTGCC GACGAGAGCACATCCACCGCCTAGCCTGGAGCGGATACCGAGGGTGCTGAGGAACAGAGACCACAACCGTGGGCGCCTACTAT TACGCCATGGACTATTGGGGCCAGGGCACACCGTCACCGTCTCCTCT | -1 |
| 591. | 9288 | H1 | GYAFSSYW | G26-W33 |
| 592. | 9288 | H1 | GGCTATGCCTTCAGCTCCTACTGG | -1 |
| 593. | 9288 | H3 | ARRETTTVGRYYYAMDY | A97-Y113 |
| 594. | 9288 | H3 | GCAAGGAGAGAGACCACAACCGTGGGCGCCTACTATTACGCCATGGACTAT | -1 |
| 595. | 9288 | H2 | IWPGDGDT | I51-T58 |
| 596. | 9288 | H2 | ATCTGGCCAGGCGACGGCGATACA | -1 |
| 597. | 9288 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A125-V222 |
| 598. | 9288 | CH1 | GCTAGCACCAAGGGACCATCGGTCTTCCCCCTGGCACCCTCCTCCAAGAGCACCTCTGGAGGCACAGCGGCCCTGGGCTGCCTGGTCAAGGACTACTTCCCAGAGCCCG TGACCGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCAAGC TCCTCTGGACACCCAGACCTACATCTGCAACGTGAATCACAAGCCCAGCAACACCAAGGTGGACAAGAAAGTTG | -1 |
| 599. | 9288 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A238-K347 |
| 600. | 9288 | CH2 | GCGCCAGAGGCAGCAGGAGGACCAAGCGTGTTCCTGTTCCCACCCAAGCCTAAGGACACACTGATGATCTCCAGGACACCCAGAGTGACCTGCGTGGTGGTGGACCGTGT CTCACGAGGACCCCGAGGTGAAGTTCAACTGGTACGTGGACGGCGTGGAGGTGCACAATGCCAAGACAAAGCCCAGGGAGGAGCAGTATAACTCTACATACCGCGTGG TGAGCGTGCTGACCGTGCTGCACCAGGATTGGCTGAACGGCAAGGAGTACAAGTGCAAGGTGAGCAATAAGGCCCTGCCCCGCCCATCGAGAAGACCATCTCCAAGG CCAAG | -1 |

TABLE YY-continued

| SEQ ID No. | Clone | Description | sequence | |
|---|---|---|---|---|
| 601. | 9288 | CH3 | GQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G348-G453 |
| 602. | 9288 | CH3 | GGCCAGCCTCCGGAACCACAGGTGTACGTGTACCCTCCATCTAGAGACGAGCTGACCAAGAACCAGGTGAGCCTGACCTGTCTGGTGAAGGGCTTTTATCCCAGCGATA TCGCCGTGGAGTGGGAGTCCAATGGCCAGCCAGAGAACAATTACAAGACAACCCCTGTCCTGGACAGCGACGGCTCTTTCGCCCTGGTCTCCAAGCTGACCGTGGA CAAGTCTCGGTGGCAGCAGGGCAACGTGTTCAGCTGTTCCGTGATGCACGAGGCACTGCACAATCACTACACCCAGAAGTCACTGTCACTGTCCCCAGGC | -1 |
| 603. | 9289 | Full | DIQLTQSPSSLSASVGDRATITCRASQSVDYEGDSYLNWYQQKPGKAPKLLIYDASNLVSGIPSRFSGSGSGTDFLTLTISSVQPEDAATYYCQQSTEDPWTFGCGTKLEIKRTVAAP SVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | -1 |
| 604. | 9289 | Full | GATATTCAGCTGACCCAGTCTCCAAGCTCTCCAAGCTCCAGCTCTCTGGCCAGCGTGGGCGATAGGGCCACCATCACATGCAGAGCCTCTCAGAGCGTGGACTACGAGGGCGATTCCTACCT GAACTGGTATCAGCAGAAGCCAGGCAAGGCCCCCAAGCTGCTGATCTATGACGCCTCCAATCTGGTGTCTGGCATCCCCAGCCGGTTCTCCGGCTCTGGCAGCGGAACA GACTTTACCCTGACAATCTCTAGCGTGCAGCCTGAGGATGCCGCCACCTACTATTGCCAGCAGTCTACCGAGGATCCCTGGACATTCGGCTGTGGCACCAAGCTGGAGA TCAAGAGAGACAGTGGCGGCTGGCAACAATCTGGTGTGTTCATCTTCCCCCTTCCGATGAGCAGCTGAAGTCCGGCACCGCTAGCGTTGTGTGCCTGCTGAACAACTTCTACCCCGG GAGGCCAAGGCTCAGTGGAAGGTGGACAACGCCCTGCAGTCCGGCAATTCTCAGGAGAGCGTGACAGAGCAGGACTCCAAGGATTCTACCTATAGCCTGTCCTCTACCC TGACACTGTCCAAGGCCGATTACGAGAAGCACAAAGTGTACGCCTGTGAAGTCACCCACCAGGGCCTGTCATCACCCAGTCACCAAGAGCTTCAATAGGGGCGAGTGC | -1 |
| 605. | 9289 | VL | DIQLTQSPSSLSASVGDRATITCRASQSVDYEGDSYLNWYQQKPGKAPKLLIYDASNLVSGIPSRFSGSGSGTDFLTLTISSVQPEDAATYYCQQSTEDPWTFGCGTKLEIK | D1-K111 |
| 606. | 9289 | VL | GATATTCAGCTGACCCAGTCTCCAAGCTCTCCAAGCTCCAGCTCTCTGGCCAGCGTGGGCGATAGGGCCACCATCACATGCAGAGCCTCTCAGAGCGTGGACTACGAGGGCGATTCCTACCT GAACTGGTATCAGCAGAAGCCAGGCAAGGCCCCCAAGCTGCTGATCTATGACGCCTCCAATCTGGTGTCTGGCATCCCCAGCCGGTTCTCCGGCTCTGGCAGCGGAACA GACTTTACCCTGACAATCTCTAGCGTGCAGCCTGAGGATGCCGCCACCTACTATTGCCAGCAGTCTACCGAGGATCCCTGGACATTCGGCTGTGGCACCAAGCTGGAGA TCAAG | -1 |
| 607. | 9289 | L1 | QSVDYEGDSY | Q27-Y36 |
| 608. | 9289 | L1 | CAGAGCGTGGACTACGAGGGCGATTCCTAC | -1 |
| 609. | 9289 | L3 | QQSTEDPWT | Q93-T101 |
| 610. | 9289 | L3 | CAGCAGAGCACCGAGGACCCATGGACA | -1 |
| 611. | 9289 | L2 | DAS | D54-S56 |
| 612. | 9289 | L2 | GACGCCTCC | -1 |
| 613. | 9289 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R112-C218 |
| 614. | 9289 | CL | AGGACAGTGGCGGCCCCAGCGTGTTCATCTTCCCCCCTTCCGATGAGCAGCTGAAGTCCGGCACCGCCTCTGTGGTGTGCCTGCTGAACAACTTCTACCCCGGGAGGC CAAGGTGCAGTGGAAGGTGGACAATGCCCTGCAGTCCGGCAATTCTCAGGAGAGCGTGACAGAGCAGGACTCCAAGGATTCTACCTATAGCCTGTCCTCTACCCTGACA CTGTCCAAGGCCGATTACGAGAAGCACAAAGTGTACGCCTGTGAAGTGACCCACCAGGGCCTGTCATCACCCAGTCACCAAGAGCTTCAATAGGGGCGAGTGC | -1 |
| 615. | 5239 | Full | QVQLVQSGGGVVQPGRSLRLSCKASGYTFTRYTMHWVRQAPGKGLEWIGYINPSRGYTNVNQKVKDRFTISRDNSKNTAFLQMDSLRPEDTGVYFCARYDDHYCLDYWGQ GTPVTVSSASTKGPSVFPLAPSSKSTSGGTAALGCLVKDYFPEPVTVSWNSGALTSGVHTFPAVLQS5GLYSLSSVVTVPSSSLGTQTYICNVNHKPSNTKVDKKVEPKSCDKTHTC PPCPAPEAAGGPSVFLFPPKPKDTLMISRTPEVTCVVVSVSHEDPEVKFNWYVDGVEHNAKTKPREEQYNSTYRVVSVLTVLHQDWLNGKEYKCKVSNKALPAPIEKTISKAKG QPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | -1 |

TABLE YY-continued

| SEQ ID No. | Clone | Description | sequence | |
|---|---|---|---|---|
| 616. | 5239 | Full | CAGGTCCAGCTGGTCCAGTCCGGAGGAGGAGTGGTCCAGCCAGGACGGTCAGCTGAGCTGACTGAGACTGCAAGGCTTCACCGGATATACCATGCACTGG<br>GTGCGGCAGGCCACCAGGAAGACTGGGTGAATGGACTGGTCAGATGAGGACCAGCCGGTACCATGCGCGTATTCTCGCTGTACTATCAGAAGACAGGTTCACTACTCTCGC<br>GATAACAGTAAGAATACCGCCTTTCACCCTGAGCTCCATGCTCGATATAACCTTCTCGCTGTACAATGCGCGTGTACCACATCTGAGGAACTGCAGCTCTGGA<br>GGCCAGGGGACTCCAGTCACCGTGAGCTCCAGTGAGCCCGTGCTCCCCATACCTTCCGCTGTCGTCAGATCTGAGGAACTGCAGCTCTGGA<br>TGCCTGGTGAAGGATTACTTCCCTGAGCCCGTGACTCTGGAACTGGAACACAAGACTTCCACCATCTGAGGAGGACTCAGTCTCAAGCGGCTGTA<br>CTCTCTGTCCTCTGTGTCCACAGTGACTTCAAGCCTGGAACCAACCTGTACCATGAAGCCTAGAACACAGCAATACTAAAGACCACCCTGATGATT<br>CAAAGAGCTGTGATAAAAACCCATACATGTGTGTGCACCAATAGAGGACGAAGTCAAGTGCTCAACCAGGATTGGCGCAAAGAGTATAAGTGCAAAGTGCAATA<br>AGCCGGACCCTGAAGTGACATGTGGTCTGAGTGTCTCCACCATAGGCTCCTGACGATGGCGTCCAAGATTGGCGCAAAGAGTATAAGTGCAAAGTGCAATA<br>GGCTCTGCCCGCACCTATCGAGAAAACATTCTAAGGCTAAAGCCTAAAGCCTAGGGAACCACCAGTCTACGTATCTCCGACGAGCTGACAAGAACCA<br>GGTCAGTCTGACTTGTCTGGTGAAAGGATTTTACCCAGAGCTGACTGTGGACAATCAAGATGCCAGCCGAGGGAACGTCTTTAGCTGTTCCGTGATGCATGAGGGCCTGCACAATCA<br>TTACACCCAGAAGTCTCTGAGTCTGTCACCCGGC | -1 |
| 617. | 5239 | VH | QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYDDHYCLDYWGQ<br>GTPVTVSS | Q1-S119 |
| 618. | 5239 | VH | CAGGTCCAGCTGGTCCAGTCCGGAGGAGGAGTGGTCCAGCCAGGACGGTCAGCTGAGACTGAGCTGCAAGGCTTCACCGGATATACCATGCACTGG<br>GTGCGGCAGGCCACCAGGAAGACTGGGTGAATGGACTGGTATCGGGTACAATTAACCCTAGCGGCTACACAAACTATAACCAGAAGGTGAAAGACAGGTTCACTATCTCGC<br>GATAACAGTAAGAATACCGCCTTTCTGCAGATGGACAGCCTGAGGCCCGAGGACACAGGCGTGTATTTCTGCGCTCGATACGATGACCACTACTGTCTGGACTATTG<br>GGGCCAGGGGACTCCAGTCACCGTGAGCTCC | -1 |
| 619. | 5239 | H1 | GYTFTRYT | G26-T33 |
| 620. | 5239 | H1 | GGGTACACTTTCACCCGATATACC | -1 |
| 621. | 5239 | H3 | ARYDDHYCLDY | A97-Y108 |
| 622. | 5239 | H3 | GCTCGATACTATGACGATCACTACTGTCTGGACTAT | -1 |
| 623. | 5239 | H2 | INPSRGYT | I51-T58 |
| 624. | 5239 | H2 | ATTAACCCTAGCAGGGGATACACA | -1 |
| 625. | 5239 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A120-V217 |
| 626. | 5239 | CH1 | GCATCAACTAAGGGACCCAGCTGTTTCCACTGGCCCCCCTCTAGTAAATCACATCTGAGGAACTGCAGCTCTGGAGATGGCTGTGAAGGATTACTTCCCAGAGCCCGT<br>CACCGTGAGCTGGAACTCCGGAGCCCTGACTTCCGGCGTGCATACCTTTCCGGCTGTGCTGCAGTCAAGCGGGCTGTACTCTCTGTCCTCTGTGGTCACAGTGCCTAGTTC<br>AAGCCCTGGGAACACAGATCTACTATCGAACGTGAATCACAAGCCTAGCAATACACAGAGTGACAAGAAAGTG | -1 |
| 627. | 5239 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A233-K342 |
| 628. | 5239 | CH2 | GCACCAGAGGCAGCAGGGACCAAGCGTGTTCCTGTTCCCACCCAAGCCTAAAGACACCCTGATGATTAGCCGACCCTGAAGTGACATGTGGTCGTGAGTGTGT<br>CACCAGGAGGACCCAGAGTCAAGTTCAACTGGTACGTGGACGGCGTCGAGGTGCATAATGCCAAGACAAAACCTCGAGGAGAACAGTACAATTCACCTATGGTCG<br>TGTCTGTCCTGACAGTGCTGCACCAGGATTGGCTGAACGGGAAAGAGTATAAGTGCAAAGTGTCCAATAAGGCTCTGCCCGCACCTATCGAGAAACCATTTCTAAGGCT<br>AAA | -1 |

TABLE YY-continued

| SEQ ID No. | Clone | Description | Sequence | |
|---|---|---|---|---|
| 629. | 5239 | CH3 | GQPREPQVYVYPPSRDELTKNQVSLTCLVKGFYPSDIAVEWESNGQPENNYKTTPVLDSDGSFALVSKLTVDKSRWQQGNVFSCSVMHEALHNHYTQKSLSLSPG | G343-G448 |
| 630. | 5239 | CH3 | GGCCAGCCTAGGGAACCACAGGTCTACGTGTATCCTCCATCTCGCGACGAGCTGACCAAGAACCAGGTCAGTCTGACTTGTCTGGTGAAAGGATTTTACCCAAGCGATATTGCCGTGGAGTGGGAATCCAATGGCCAGCCCGAAAACAATTATAAGACAACCCCTGTCCTGGATTCTGATGGCAGTTTCGCACTGGTCAGTAAGCTGACTGTGGACAAATCAAGATGCGCAGCGGGAACGTCTTTAGCTGTTCCGTGATGCATGAGGCCCTGCACAATCATTACACCCAGAAGTCTCTAGTCTGTCACCCGGC | -1 |
| 631. | 2304 | Full | QVQLVQSGGGVVQPGRSLRLSCKASGYTFTRYTMHWVRQAPGKGLEMIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPVLDSDGSFALVSKLTVDKSRWQQGNVFSCSVMHEALHNHYTQKSLSLSPGK | -1 |
| 632. | 2304 | Full | CAGGTCCAGCTGGTCGAGAGCGGAGGAGGAGTGGTCCAGCCAGGACGGTCTCTGAGACTCTGCAAGGCATCAGGGTACACATTTACCCGATATACCATGCACTGGGTGCGGCAGGCCAGGGAATGGAATCGGATATACAATCCAAGAATACCCTTCCAGGGGATACCATATATGACGAAGGATCAGGTTCACTATCAGCCGCGATAACTCCAAGAATCCAGCCTCTACCGTGACTCTCTACTAAGGGACCCAGTGGTGTTTCCAGAGCTCCATAGTTGGAACTGGAAGCTGGAGCTGAATCACGATCAGAGAAGGTGAAAGACAGAGGTTCACTATCAGCCGCCTGTCTCTGTGGTCACAGTGCCAAGCCTTCTAATACTAAGGGACCAGAAGAAGTGGAACCAAGAGTTGTGATAAAAACCATATACATGACGAAGTCTTAAAGACACCTGAGGTGCATAAGTGCAAAGTGTCAATAACCGGACCCCTGAAGAGAACAACCATTTCTAAGGCAAAAACCATTTCTAAGGCAAAAACCATTTGTCTGGTGAAAGATTTTCCAAGCTGATTTAACCCAGCCAAGCTAGTGAGGAACAGGAAAATGCCAGCCGCAGCAGCTCTTTAGTTGTTCAGTGACATGAGGCTCTGCACAATCATTAACACCCAGAAGAGCCTTCGCGTCTGTCTCCCGGCAAA | -1 |
| 633. | 2304 | VH | QVQLVQSGGGVVQPGRSLRLSCKASGYTFTRYTMHWVRQAPGKGLEMIGYINPSRGYTNYNQKVKDRFTISRDNSKNTAFLQMDSLRPEDTGVYFCARYYDDHYCLDYWGQGTPVTVSS | Q1-S119 |
| 634. | 2304 | VH | CAGGTCCAGCTGGTCGAGAGCGGAGGAGGAGTGGTCCAGCCAGGACGGTCTCTGAGACTCTGCAAGGCATCAGGGTACACATTTACCCGATATACCATGCACTGGGTGCGGCAGGCCAGGGAATGGAATCGGATATACAATCCAAGAATACCCTTCCAGGGGATACACATTAACCCTTCGCGCCCGAGGATACCAGGCGTGTATTTCTGCGCACGATACTATGACGATCACTACTGTCTGGACTATGGCCAGGGGGACTCCAGTGACTCACCGTGAGCTCC | -1 |
| 635. | 2304 | H1 | GYTFTRYT | G26-T33 |
| 636. | 2304 | H1 | GGGTACACTTTCACCCGATATACC | -1 |
| 637. | 2304 | H3 | ARYYDDHYCLDY | A97-Y108 |
| 638. | 2304 | H3 | GCACGATACTATGACGATCACTACTGTCTGGACTAT | -1 |
| 639. | 2304 | H2 | INPSRGYT | I51-T58 |
| 640. | 2304 | H2 | ATTAACCCTTCCAGGGGATACACA | -1 |
| 641. | 2304 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A120-V217 |

TABLE YY-continued

| SEQ ID No. | Clone | Description | sequence | |
|---|---|---|---|---|
| 642. | 2304 | CH1 | GCCTCTACTAAGGGACCCAGTGTCTGTTTCCACTGGCTCCCTCTAGTAAATCCACACTGAGGAACTGCAGCTCTGGGATGCTGCTTGAAGATTACTTCCAGAGCCCGT CACCGTGAGTTGGAACTCAGGAGCTCTGACTAGCGGCGTCCATACTTTCCCGACTGCAGTGTCAAGCGGCGTGTACAGCGGCTACTGGTTCACAGTGCCTAGTT CAAGCCTGGGAACACAGACTTATATCTGCAACGTGAATCACACAAGCCTTCTAATACTAAAGTCGAACAAGAAGTG | -1 |
| 643. | 2304 | CH2 | APELLGGPSVFLFPPKPKDTLMISRTPEVTCVVVDVSHEDPEVKFNWYDGVEVHNAKTKPREEQYNSTYRVVSVLTVLHQDWLNGKEYKCKVSNKALPAPIEKTISKAK | A233-K342 |
| 644. | 2304 | CH2 | GCACCAGAGCTGCTGGGAGGACCAAGTCAACTGGATGATCTCCTGTTTCCACCCAAGCCTAAAGACACCCTGAGTGATGATTAGCCAAGCCTGAAGTCACATGTGTGTCGTGGACGTGA GCCATGAGGAGTCCCCGAAGTCCAAGTTCAACTGGTACGATGGCGTCGAGTGCATAATGCCAAGACCAAAACCTAGAGAAGAACAGTACAATTCAACCTATAGGGTCG TGAGCGTCCTGACAGTGCTGCACCAGGACTGGCTGAATGGGAAGGAGTAATAAGTGCAAAGTGTCCAATAAGGCACTCGGCCGCCCCTATCGCAGAAACCATTTCTAAGGC AAAA | -1 |
| 645. | 2304 | CH3 | GQPREPQVYVYPPSRDELTKNQVSLTCLVKGFYPSDIAVEWESNGQPENNYKTTPPVLDSDGSFAFLVSKLTVDKSRWQQGNVFSCSVMHEALHNHYTQKSLSLSPG | G343-G448 |
| 646. | 2304 | CH3 | GGGCCAGCCTCAGGGAACCTCAGGAGCCTGCTGATCGAGCAAGGCGCGACGAGCGTGCGGATCGACCAAGGTCTCCCTGACTTGTCTGTGTGAAAGGATTTTACCCAAGTGATAT TGCTGTGGAGTGGGAATCAAATGGCCAGCCTGAAAATAATTACACCCAAACTGTGCTGACAGCGATGGCGTCCCTCCAAGCTGACTGTGGATA AATCTAGAGTGGACAGGGGAACGTCTTTTGTTGTTCAGTGATGCATGAGGCCCTGCACAATCATTACACCCAGAAGCCTGTCCCTGTCCCCGG | -1 |
| 647. | 3537 | Full | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGT LVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP CPAPELLGGPSVFLFPPKPKDTLMISRTPEVTCVVVDVSHEDPEVKFNWYVDGVEHNAKTKPREEQYNSTYRVVSVLTVLHQDMLNGKEYKCKVSNKALPAPIEKTISKAKGQP REPQVYTLPPSRDELTKNQVSLTCLVKGFYPSDIAVEWESNGQPENNYLTWPPVLDSDGSFFLYSKLTVDKSRWQQGNVFSCSVMHEALHNHYTQKSLSLSPGK | -1 |
| 648. | 3537 | Full | CAGGTCCAGCTGAAGCAGAGCGGACCAGGACTGGTCCAGCCAAGCCAGTCTCTGAGCATCACCTGCACAGTTCTCCGGATTCTCTGACTAACTACGGACACTGGGT GCGACAGAGTCCAGGAAAGGCCTGGAATGGCTGGGAGTGATCTGGAGCGGGGAACACCGACTACAACACCCCTTTCACAAGCCGTCTGATCAATAATCCCCTTTACGACAGTGCGTCAATTACAAGGATAA CTCTAAGAGTCAAGTTCTTCAAGATGAACAGCCTGCAGTCCAATGACACCGCAATATACTACTGTGCCCGTGCACTATACGATTACGAGTTCGCATATTGGGGA GCAGGGAACCCTGGTGACCGTCTCCAGCCTCCACCAAGGGCCCATCCGTGTTTCCCCTGGCCCCAAGCTGCGACAACTTCTGGGGGCACATCAGCGGCCCTGGGCTGCCTGGTGCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGATGAGCTGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGATGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA | -1 |
| 649. | 3537 | VH | QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGT LVTVSA | Q1-A119 |
| 650. | 3537 | VH | CAGGTCCAGCTGAAGCAGAGCGGACCAGGACTGGTCCAGCCAAGCCAGTCTCTGAGCATCACCTGCACAGTTCTCCGGATTCTCTGACTAACTACGGACACTGGGT GCGACAGAGTCCAGGAAAGGCCTGGAATGGCTGGGAGTGATCTGGAGCGGGGAACACCGACTACAATACCCCTTTTACAAGCCGGTCTCAATTAACAAGGATAA CTCTAAGAGTCAAGTTCTTCAAGATGAACAGCCTGCAGTCCAATGACACCGCTATATTGCGCTAGAGACACTGATATTATTGCGCCATATTGGGG GCAGGGAACTCTGGTCACCGTCTCTGCC | -1 |
| 651. | 3537 | H1 | GFSLTNYG | G26-G33 |

TABLE YY-continued

| SEQ ID No. | Clone | Description | Sequence | |
|---|---|---|---|---|
| 652. | 3537 | H1 | GGATTCTCTGACTAACTACGGA | -1 |
| 653. | 3537 | H3 | ARALTYDYEFAY | A96-Y108 |
| 654. | 3537 | H3 | GCTAGAGCACTGACATACTATGATTACGAGTTCGCATAT | -1 |
| 655. | 3537 | H2 | IWSGGNT | I51-T57 |
| 656. | 3537 | H2 | ATCTGGAGCGGAGGAACACC | -1 |
| 657. | 3537 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A120-V217 |
| 658. | 3537 | CH1 | GCTAGTACAAAGGGACCAAGCGTCTTTCCACTGGCACCAAGCTCCAAATCAACAAGCGGAGGCACTTCCGGGGTGCACTGTCTCAGTCAGCTCTACACCTTCCCGCCGTCCATACCTTCTCATGGAACAGCGGCACTGACCTCTGGACTCCTGGTCAAGGACTACTTCCCAGAGCCGGTCACAGTGTCCTGGAATCAGTGGACACAGCGTGCACACCTTCCCGGCTGTCCTGCAGTCAGCTTAGTGCCTGTACTCTGTCAAGCGTGTCACAGTGCCATCCTCTAGTCTGGGACTCAGACCTATATCTGCAACGTGAATCACAAGCCCTTCCAATACTAAAGTCGACAAGAAAGTG | -1 |
| 659. | 3537 | CH2 | APELLGGPSVFLFPPKPKDTLMISRTPEVTCVVVDVSHEDPEVKFNWYVDGVEVHNAKTPREEQYNSTYRVVSVLTVLHQDWLNGKEYKCKVSNKALPAPIEKTISKAK | A233-K342 |
| 660. | 3537 | CH2 | GCACCAGAGCTGCTCGGGGGACCATCCGTGTTCCTGTTTCCACCCAAGCCTGAGGTCACGTGGATGGCTGAGGTCAAGTTCAACTGGTACGTGGATGGCGTGGAGGTGCATAATGCCAAGACACCTCGAGAGGAACAGTACAATAGTACATATAGAGTGTGTCAGTGCTGACCGTCTGCACCAGGACTGGCTGAATGGCAAGGAGTATAAGTGCAAGGTCTCCAATAAGGCCCTGCCCGCTCCTATCGAGAAAACCATTAGCAAGGCCAAA | -1 |
| 661. | 3537 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G343-G448 |
| 662. | 3537 | CH3 | GGGCAGCCTAGGGAACCACAGGTCTACGTGCTGCCTCCAAGCCGGGACGAGCTGACCAAAGAACCAGGTCAGCCTGTCCTGTGTCTGGTGAAAGGGTTCTATCCCTCTGATATCGCTGTGGAGTGGGAAAGTAATGACAGCAGCTGCTTCTGCAGAGATCTTCTTCTGTATAGCAAGCTGACCGTGGATAAATCCAGGTGGCAGCAGGGCAACGTCTTTTCCTGTTCTGTGATGCATGAGGCCCTGCACAATCATTACACCCAGAGAGTCTGTCACTGAGCCCTGGC | -1 |
| 663. | 3299 | Full | QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLITYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK | -1 |
| 664. | 3299 | Full | CAGGTCCAGCTGGTCCAGAGCGGCGCCGAAGTGAAGAAACCCGGCGCTAGCGTGAAGGTGTCTTGTCAAGGTGAGTTGCAAAGCTTCAGGCTACCAATTCCGAAGCTCTATATCAGTGACCATGCGGGCAGGCACCAGGACTAGCACCTCCACAGCATACATGGAACTGAGGTCCTCTGCGGTAGGAGCGGAGCGAAGAGTCACCCACACCCTACGTAGTACCGCCGTCCACCGAGCAGAATCAAGGAGGATTATATCCGACCGAGAAACCGAGCTCTGGGGACAGGGCACCCTGGTCACAGTGTCTAGCACAAAGGGACCTTCCGTGTTCCCACTGGCTCCTTCCTCCAAGAGCACCAGCGGCGGAACAGCGGCACTCGGATGGTCTGGAACTGGTCAACCAGACTACTTCCCAGAGCCAGTCACCGTGTCCTGGAATAGCGGCGCCCTGACCAGCGGCGTCCACACCTTCCCAGCCGTCCTGCAGAGTTCGTCTGGTCTATAAAAACATATGCTCCTCGTGGTCACCGTGCCCCCTCAAGTCTCAAGGGACCCAGACCTACATCAAGAGGAGAGACACCTGATGAACCCAAGTGCATCATCTGCTGTGTGTGAGCGCAGGCAGCTCCACAGGACGCCACAGTGTGAGTGGAACGGAAAGCCTTGCGTGCCAAGTCTGACCCCAAGCCCCTGCTCCCTGAGTGCCAAGATAAGGCTACGTGATGGCGTGCACCGTGTCCAAAGGGTCATAATGTCGGTCATAATGTCAAATGTCCAATTAGCAGCGACACCCGAGGAGCAGTACACGTCCAACCTACTTCTCGTGGTGCTGGTGCTAACTTAAGCAGTTGCCACAAACTCACCGACGACCATCTTAAGGACAAAGTTCAAGAAACCATCTCCAATGCCAAAGGCCAGCCTCGCGAACCACAGGTCTGAGTCTGGCCACAGTGTACGTGCTGCCTCCAAGTCGAGACGAGCTGACCAAGAACAAGGCACTGCCCCCGCCCCTATCGAGAAAACCATTTCAAGGACAAAGCCAAGGGTCAGCCTCGCGAACCACAGGTCTACGTGCTGCCTCCAAGCGACGACGAGCTGACCAAGAACAAG | -1 |

TABLE YY-continued

| SEQ ID No. | Clone | Description | sequence | | |
|---|---|---|---|---|---|
| 665. | 3299 | VH | CAGGTCCAGCTGGTGCAGTCTGGGGCTGAGGTGAAGAAGCCTGGGGCCTCAGTGAAGGTCTCCTGCAAGGCTTCTGGATACTTCACCGATATGGCCAGCAGAGAATTAATGGCCAGGAGGTGGAATTAATGAAGGCCAGGAGAACAATTACCTGACTTGGCCCCTGCTGGACAGGCCGATGCAGCTTCTCCCTGTATTCAAAGCTGAACGTGTGATAAAAGCCAAGCTGTTTCTCTGTTCTGATGCATGAAGCCCTGCACAATCATTACACCAGAGAGTCTGTCACTGAGCCCGGCAAA | Q1-S120 | |
| 666. | 3299 | VH | QVQLVQSGAEVKKPGASVKVSCKASGYTFTDMASRNYMASRVLQGQGLEMGWIYAGTGSPSYNQKLQGRVTMTDTSTSTAYMELRSLRSDDTAVYYCARHRDYYSNSLTYWGQGTLVTVSS | −1 | |
| 666. | 3299 | VH | CAGGTCCAGCTGGTCCAGAGCGGCGCCGAAGTGAAGAAACCGGGCGCTTCTGTCAAGGTGAGTTGCAAAGCTTCAGGCTACACCATTCCGAAGCTCCTATATCAGCTGGGTGCGGCAGGCACCAGGAAAAGGGCTGGATATGGGTATTTCTTGTGCAGAAGGTCATGGAGCCTCGATAACAAATCCAAGAAGCCAAGCCGGAGCACAGAAGAGTGATGACAGCCACAGACACTAGCACCCTCCAAGACATGAAACTGAGCAACTAGACAAGCCACGGCACAGACAACCGCGTACTATTGCGCACAGAGATTACTATTCTTAATAGTCTGACCTATTGGGGACAGGGCACCCTGGTCACAGTGTCTAGT | G26-Y33 | |
| 667. | 3299 | H1 | GYTFRSSY | −1 | |
| 668. | 3299 | H1 | GGCTACACATTCCGAAGCTCCTAT | A97-Y109 | |
| 669. | 3299 | H3 | ARHRDYYSNSLTY | −1 | |
| 670. | 3299 | H3 | GCACGGCACAGAGATTACTATTCTAATAGTCTGACCTAT | I51-P58 | |
| 671. | 3299 | H2 | IYAGTGSP | −1 | |
| 672. | 3299 | H2 | ATCTACGCTGGCACAGGGAGTCCC | A121-V218 | |
| 673. | 3299 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | −1 | |
| 674. | 3299 | CH1 | GCTAGCACAAAGGGGCCTTCCGTGTTCCCACTGGCACCCTCAAGCAACTAGCGGAGGAACCGCAGTCTGGGATGTCTGGTGAAGGACTACTTCCCAGAGCCGTCACAGTGAGTTGGAACTCAGGGGCACTCCATACACCATTCCTGCCGTCCTGCAGTCTGTACTCCCTGAGTTCAGTGTCACAAGCTCCTCTCTGGGAACTCAGACCTATATCTGCAACGTGAATCACAAGCCATCCAATACTAAGGTCGACAAGAAAGTG | A234-K343 | |
| 675. | 3299 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | −1 | |
| 676. | 3299 | CH2 | GCACCAGAGCTGCTGGGAGGACCATCCGTGTTCCTGTTTCCACCCAAGCCTAAAGACACCCTGATGATTAGCAGGACACCTGAGGTCACATGCGTGGTGGTGGACGTGAGCCACGAGGACCCCGAGGTCAAGTTCAACTGGTACGTGGATGGCGTGGAGGTGCATAATGCTAAGACCAAACCCAGAGAAGAACAGTATAACAGCACCTATCGGGTGGTCAGCGTCCTCACCGTCCTGCACCAGGACTGGCTGAACGGCAAGGAGTATAAGTGCAAAGTCTCCAACAAAGCCCTCCCAGCCCCTATCGAGAAAACCATTTCTAAGGCAAAA | −1 | |
| 677. | 3299 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G344-G449 | |
| 678. | 3299 | CH3 | GGGCAGCCTCGGGAACCACAGGTCTACGTGCTGCCTCCAAGTCGAGACGAGCTGACAAAGAACCAGGTCAGCCTGCTGTGTCTGGTGAAAGGATTCTATCCTTCCGATATCGCCGTGGAGTGGGAATCTAATGGCCAGCCAGAGAACAATTACCTGACTTGGCCCCCTGTCCTGGACAGCGATGGCTCTTTCTTCCTGTATTCAAAGCTGACCGTGGATAAAAGCCGGTGGCAGCAGGGCAACGTCTTTTCCTGTCTGTGATGAAGCATCATTACACCAGAGAGTCTGTCACTGAGCCCGGGC | −1 | |
| 679. | 8071 | Full | QIVLTQSPAIMSSPGEKVTMSCSATSSVTYMYWYQQKPGSSPKPMIFRTSNLASGVPTRFSGSGSGTSYSLTISSMEAEDAATYYCQHYHIYPRTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | −1 | |

TABLE YY-continued

| SEQ ID No. | Clone | Description | sequence | |
|---|---|---|---|---|
| 680. | 8071 | Full | CAGATGTCCTGACTCAGAGCCCCGTCTATCATGTCCTCATCCCCTGGCGAGAAGGTCACTATGTCTTGCTCTGCCTCCACTGGGGAGTCTGTTTCCACTAGTAACTATGCCAACTGGTACCAGCAGAAGCCAGGCAGCTCCCCCAAACTTGGACTTCGGTATGGGCAGTGGCAACCGCCTGGAATCTCCCCTCCCAGGAACTAAACTACCTTATAGTCACAATTTCTAGTATGGAGGCCGAAGACGCCGCTACCTACTATTGTCAGCAGTATCACTACATATATTCCCCTCGGACGTTCGGTGGAGGCACCAAGGGGCCAAGTGAAACCATCAAGACGGGTGCGCGCCAGTGTCTTCATTTTTCCCCCTAGCGACGAACAGCTGAAGTCTGGGACTGCCTCTGTTGTGTGCCTGCTGAACAACTTCTACCCCAGAGAGGCCAAAGTACAGTGGAAGGTGGATAACGCACTGCAGTCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGC | QIVLTQSPAIM55SPGEKVTMSCSATSSVTYMYWYQQKPGSSPKPWIFRTSNLASGVPTRFSGSGSGTSYSLTISMEAEDAATYYCQHYHIYPRTFGGGTKLELK | Q1-K106 | -1 |
| 681. | 8071 | VL | CAGATGTCCTGACTCAGAGCCCCGTCTATCATGTCCTCATCCCCTGGCGAGAAGGTCACTATGTCTTGCTCTGCCTCCACTAGTAACTATGGTACCAGCAGAAGCCAGGCAGCTCCCCCAAACTTCGGACTTCGGTATGGGCAGTGCCCACGCGGGTGCCCAGATTTCGGACTAACTAGTGGACTTAAGATACCTATATAGTCTGACAATTTCTAGTATGGAGGCCGAAGACGCGGAACTAAACTGGAGCTGAAA | QIVLTQSPAIM55SPGEKVTMSCSATSSVTYMYWYQQKPGSSPKPWIFRTSNLASGVPTRFSGSGSGTSYSLTISMEAEDAATYYCQHYHIYPRTFGGGTKLELK | | -1 |
| 682. | 8071 | L1 | SSVTY | | S27-Y31 |
| 683. | 8071 | L1 | TCCTCCCTGACATAC | | -1 |
| 684. | 8071 | L3 | QHYHIYPRT | | Q88-T96 |
| 685. | 8071 | L3 | CAGCACTACCATATCTACCCAAGAACA | | -1 |
| 686. | 8071 | L2 | RTS | | R49-S51 |
| 687. | 8071 | L2 | CGGACTTCC | | -1 |
| 688. | 8071 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | | R107-C213 |
| 689. | 8071 | CL | CGAACCGTGGCGGCCCCAGTGTCTTCATTTTTCCCCCTAGCGACGAACAGCTGAAGTCTGGGACTGCCTCTGTTGTGTGCCTGCTGAACAACTTCTACCCCAGAGAGGCCAAAGTACAGTGGAAGGTGGATAACGCACTGCAGTCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGC | | -1 |
| 690. | 1109 | Full | DIQLTQSPASLAVSLGQRATISCKASQSVDYDGDSYLNWYQQIPGQPPKLLIYDASNLVSGIPGQPPKLLIYDASNLVSGIPPRFSGSGSGTDFTLNIHPVEKVDAATYHCQQSTEDPWTFGGGTKLEIKGGGGSGGGGSGGGGSQVQLQSGGGSGSVKISCKASGYAFSSYWMNWVKQRPGQGLEWIGQIWPGDGDTNYNGKFKGKATLTADESSSTAYMQLSSLASEDSAVYFCARREYYTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSVDDIQLTQSPAIMSASPGEKVTMTCRASSSVSYMNWYQQKSGTSPKRWIYDTSKVASGVPYRFSGSGSGTSYSLTIISSMEAEDAATYYCQQWSSNPLITFGAGTKLELKHHHHHHH | | -1 |
| 691. | 1109 | Full | | | -1 |
| 692. | 1109 | Full | GATATTCAGCTGACACAGTCTCCAGCCAGTCTCGGCAGTCGGCAGTGGCCAGCCTGGGCCAGAGGGCCACCATCAGCTGCAAGGCAAGTCAGAGTGTCGACTACGATGGGGACAGCTATCTGAATTGGTACCAGCAGATCCCCGGACAGCCCCCAAAGCTCCTGATCTACGATGCCTCAAATCTGGTCTCTGGAGTCCCAGATTTCTGGAAGTGGCTCAGGGACCGATTTTACACTGAACATTCACCCTGTGGAGAAGGTCGACGCGCTACCTACCATTGCCAGTGCAGGAGAGAGGGCTCAGAGAGGACTGCCGGAGCTGAGACCTGAAGCTCCGTCAGATTTCCTGTAAAGCATCTGGCTATGCCTTTCTTACTACGCTGATGAATGGGTGAAGCAGAGACCAGGACAGGGACTTGAGTGGATTGGCCAGATTTGGCCTGGGATGGAAACACAACAATGTCAACGGGAAGTTCAAAGGCAAGGCCACACTGACTGCCGATGAATCAAGCAGCACAGCCTACATGCAACTCAGCAGCCTTACCTCTGAGGATTCCGCCGTCTATTACTGTGCAAGATATCAAGCTGCAGATATCAGTGGCTACAGTGTCCGATATCAAGCTGCAGCCAGAGACCTGGGGCCAAGGCACCACTCTCACAGTCTCCTCAGTAGAGGGGCCAAGGGCTATATGATGGAGCTGACCCCCTCAGTTTGGCTACTGTGATCATTTTGTCTGGATTATGGGGAAACAATGCGAAAGTCCTCCTTATAGCTTCAAGGCCACCCAAGGCAGATCCTGCCATCATTACTGCCGGAGGATAGCTGGGGCCAAGGCAGGGGTCCAAGGCGTAGATCCAGAAGTCAAGGATAAAGCCACTCGACCTGGGGCCAGGGCCAAGGGCTGGCTCAGGGACCGATATATCCAGCTGACCCAG | | -1 |

TABLE YY-continued

| SEQ ID No. | Clone | Description | Sequence | |
|---|---|---|---|---|
| 693. | 1109 | VL | TCCCCTGCCATTATGAGCGCTTCCCCAGGCGAGAAGTGACAATGACTTGCAGGGTCTAGTCAAGGCTCTCTTATGAATTGGTATCAGCAGAAGTCTGGCACTAGTCC TAAACGATGGATCTATGACACCCTCCAAAGTGGCATCTGGGGTCCCATACCGGTTCTCTGGCAGTGGGTCAGGGACCTCTTCTCTGACCATTTCCTCTATGAGGCAG AAGATGCAGCCACTTACTGTCAGCAGTGAGTTCAAATCCCTGACATTTGGCGCCGGGACTAAGCTGGAACTGAAACACCACCATCACCAT | D1-K111 |
| 694. | 1109 | VL | DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK | -1 |
| 695. | 1109 | L1 | GATATTCAGCTGACACAGTCTCCAGCTCAGTCTCTGGCAGTGAGCCTGGACAAGCCAGTCTCCGTCAGCTATCTGACTACGATGGGGACAGCTATC TGAACTGGTACCAGCAGATTCCCGGACAGCCCCCTAAACTGCTGATCTACGACGCCTCAAATCTGTGAGCGGCATCCCACCCAGATTCTCTGGAAGTGGCTCAGGGACC GATTTTACACTGAACATTCACCCCGTGGAGAAGGTCGACGCCGCTACCTACCATTGCCAGCAGTCCACTGAGGACCCCTGGACCTTCGGAGGAACAAAGCTGAAA TCAAAA | Q27-Y36 |
| 695. | 1109 | L1 | QSVDYDGDSY | -1 |
| 696. | 1109 | L1 | CAGTCCCTCGACTACGATGGGGACAGCTAT | Q93-T101 |
| 697. | 1109 | L3 | QQSTEDPWT | -1 |
| 698. | 1109 | L3 | CAGCAGTCCACTGAGGACCCCTGGACC | D54-S56 |
| 699. | 1109 | L2 | DAS | -1 |
| 700. | 1109 | L2 | GACGCCTCA | Q127-S250 |
| 701. | 1109 | VH | QVQLQQSGAELVRPGSSVKISCKASGYAFSSYWMNWVKQRPGQGLEWIGQIWPGDGTNYNGKFKGKATLTADESSSTAYMQLSLASEDSAVYFCARRETTVGRYYYAM DYWGQGTTVTVSS | -1 |
| 702. | 1109 | VH | CAGGTGCAGCTGCAGCAGAGCGGAGCAGAACTGGTGAGACCTGGAAGCTCCGTCAAGATTTCCTGTAAAGCATCTGGCTATGCCTTTTCTAGTTACTGGATGAATTGGG TGAAGCAGAGGCCAGGACAGGGACTGGAGTGGATCGGACAGATTTGGCCTGGCGATGGAGACAATAACTACAATGGAAAGTTCAAAGGCAAGGCTACCCTGACAGCA GACGAATCAAGCTCACAGCTTCCACAGCTTCTAGTCTGTCAGCTGGCATCAGAGGATAGCGCCGTGTATTTTGCGCTCGGAGAGAACCACACTGTCGGCCGCTACTATTA CGCCATGGACTACTGGGGCCAAGGGACCACAGTGACCAGTCTCAAGC | -1 |
| 703. | 1109 | H1 | GYAFSSYW | G152-W159 |
| 704. | 1109 | H1 | GGCTATGCCTTTTCTAGTTACTGG | -1 |
| 705. | 1109 | H3 | ARRETTVGRYYYAMDY | A223-Y239 |
| 706. | 1109 | H3 | GCTCGGAGAGAAACCACAACTGTCGGCCGCTACTATTACGCCATGGACTAC | -1 |
| 707. | 1109 | H2 | IWPGDGDT | I177-T184 |
| 708. | 1109 | H2 | ATTTGGCCTGGGGATGGAGACACC | -1 |
| 709. | 1109 | VH | DIKLQQSGAELARPGASVKMSCKTSGYTFTRYTMHWVKQRPGQGLEWIGYINPSRGYTNYQKFKDKATLTTDKSSSTAYMQLSSLTSEDSAVYYCARYDDHYCLDYWGQG TTLTVSS | D256-S374 |

TABLE YY-continued

| SEQ ID No. | Clone | Description | sequence | |
|---|---|---|---|---|
| 710. | 1109 | VH | GATATCAAGCTGCAGCAGTCTGGAGCAGAGCTGGCTCGACCAGAGACTGTGAAGATGTCATGTAAAACCAGCGGCTATACTTTCACCAGGTACACAATGCACTGGG TGAAACAGCGCCCAGGACAGGCCTGAATGGATCGGATACATTAACCCTCCAGGGCTATACCAACTACAATCAGAAGTTCAAGGATAAAGCCACTCTGACTACGA CAAGTCCTCTAGTACCGCTTATATGCAGCTGTCAAGCCTGACATCCGAGACTCTGCAGTGTATTACTGCGCCCGCTATTACGACGATCATTATTGTCTGGATTACTGGGG GCAGGGAACAACTCTGACTGTGTCCTCT | -1 |
| 711. | 1109 | H1 | GYTFTRYT | G281-T288 |
| 712. | 1109 | H1 | GGCTATACTTTCACCAGGTACACA | -1 |
| 713. | 1109 | H3 | ARYDDHYCLDY | A352-Y363 |
| 714. | 1109 | H3 | GCCCGCTATTACGACGATCATTATTGTCTGGATTAC | -1 |
| 715. | 1109 | H2 | INPSRGYT | I306-T313 |
| 716. | 1109 | H2 | ATTAACCCCTCCAGGGCTATACC | -1 |
| 717. | 1109 | VL | DIQLTQSPAIMSASPGEKVTMTCRASSSVSYMNWYQQKSGTSPKRMIYDTSKVASGVPYRFSGSGSGTSYSLTISMEAEDAATYYCQQWSSNPLTFGAGTKLELK | D393-K498 |
| 718. | 1109 | VL | GATATCCAGCTGACCCAGTCCCCTGCCATTATGAGCGCTTCCCCAGGCGAGAAGTGACAATGACTTGCAGGGCTAGTCAAGCTCTCTTATATGAATTGTATCAGCA GAAGTCTGGCACTAGTCCTAAACGAATGATCTATGACACCTCCAAAGTGGCATCTGGGGTCCCATACCGGTTCTCTGGCAGTGGGTCAGGAACTAGCTATTCCCTGACCA TTTCCCTATGGAGGCAGAAGATGCAGCCACCTATTACTGTCAGCAGTGGAGTTCAAATCCCCTGACCTTTGGCGCCGGGACTAAGCTGGAGCTGAAA | -1 |
| 719. | 1109 | L1 | SSVSY | S419-Y423 |
| 720. | 1109 | L1 | TCAAGCGTCTCTTAT | -1 |
| 721. | 1109 | L3 | QQWSSNPLT | Q480-T488 |
| 722. | 1109 | L3 | CAGCAGTGGAGTTCAAATCCCCTGACA | -1 |
| 723. | 1109 | L2 | DTS | D441-S443 |
| 724. | 1109 | L2 | GACACCTCC | -1 |
| 725. | 2170 | Full | DIKLQQSGAELARPGASVKMSCKTSGYTFTRYTMHWVKQRPGQGLEWIGYINPSRGYTNYNQKFKDKATLTTDKSSSTAYMQLSLTSEDSAVYYCARYDDHYCLDYWGQG TTLTVSSVEGGSGSGSGGSGGVDDIQLTQSPAIMSASPGEKVTMTCRASSSVSYMNWYQQKSGTSPKRMIYDTSKVASGVPYRFSGSGSGTSYSLTISMEAEDAATYCQ QWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSRDELTKNQVSLTCLVKGFYPSDIAVEWESNGQPENNYKTTPPVLDSDGSFALVSKLTVDKSRWQQGNVFS CSVMHEALHNHYTQKSLSLSPGK | -1 |

TABLE YY-continued

| SEQ ID No. | Clone | Description | sequence | |
|---|---|---|---|---|
| 726. | 2170 | Full | GACATCAAACTGCAGCAGTCAGGAGCTGAGCTGGCACGAGAGCGGAGCTGAGTGAAGCTGAGCGGACCAGTGTGAAAATGTCATGCAAGGCTACACCTTCACACGGTATACTATGCACTGG GTGAAACAGACTCCCTACAGCTTCACTGTCAGCTCCGGAAGGAGGGAGCGGAGGATCTGAATGACAGCTCCTAGTGACTCACTGTGTACTATTGCGCAAGTCCGGAGCTAGTGAGGACTCAGTTCAGATGGACATCATTACTGTCTGATTATTGGG GACAGGGCACTACCCCTGACTCTGCAGCCTCGAGGAGGGAGCGGAGGCTCCGAGGATCCGAGGTGGAGGCTGTGACGATATCCAGCTGACCCAGTCCA GCAATTATGTCCGCTCTCCGGCAGACACATCCAAGGTGCCTTCTGCCTCTAGTTCAGTGAGCTACACTGAACTTCCTACTCTCTTAGTGGTCAGGAGTCGGCACCATTAGTCACCAGCCAAGAGAG CCGCTACTACATATTGTCAGCAGTGGTCTAGACACATTGTCGGGGCGGGACCAAGGTTGAAACTGAAACTGTCTGGGGACCCCAAAACCAAATCAGGCTCCGTGTTCCCCAAAACAAACCAAATGATGATCCTCCAAGATCAAGCTCAAGGACAGAACAGAACACAGCG TTGCCCACCTTGTCCACACGAGGACCCACGAGGACCCGAAGTCAATCAGATCCTCTGACACTGTGCATCAGATTCAACTGAGATCAAGGAAGGAGTACAAATGCAAATGCAAGGTGTCAACAAGGTGCTTCCAATCAGAA TGGTGCTGGACGTTGACCTCCTGCAGCTCCCCGAGATCTGCTGTATCCCGGGGACCCCGAAGAACCATCAGGGCAGACAAAACCAGGTCTCTCTGACAGTGCTGGTGAAGG GACCATTTCTAAAGCAAAGGGCCAAGCCCCCAGAACCGAGAAGAACCATCCAGGCGGGAGTCCCGAGAATCCCCCTGCCTGGCACTCCCGATGGATCCTGCTCTCTGCTGGGGGT GGTTTATCCATCTGATATTGCTGTGGAGAGTGGAGCAGGACCCAAGAGCAGGCCAGGTGACAAAGTAATGACAGTTGCTCAGTGATGCCACAATCATTACGTCCCACACACTCCACATCAGAAGCTGTCCCTGT CTCCCGGCAAG | -1 |
| 727. | 2170 | VH | DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYDDHYCLDYWGQG TTLTVSS | D1-S119 |
| 728. | 2170 | VH | GACATCAAACTGCAGCAGTCAGGAGCTGAGCTGGCACGAGAGCGGGCAGCTGTGAAGATGTCATGCAAGACCAAGGCCTACACCTTCACACGGTATACTATGCACTGG GTGAAACAGACAGACCCCTACAGCTTCACTGTCAGCTCCGGAAAGTGACTATGGAAATGACAGCTTGAATGACAGCTTCAGTGACTTGTACTATTGCGCAAGTCCCAGTCCAG ATAAGACTCCCTACAGCTTCACTGTCAGCTCTGGTATTCAACTGGCCAAGGCAGCTGTATCACTATGTGCCAAGGTACTATCAGAAGTTAAAGACAAGCCACCTGACCACACGATCAGAATACAACACTCCACTTACCAAATCAAGAGGTTACTATACTAACTATCGCCAAGGTACTCAGTGTACATGACGACCATTACTGTCTGATTATTGGG GACAGGGCACTACCCTGACTGTCAGCTCC | -1 |
| 729. | 2170 | H1 | GYTFTRYT | G26-T33 |
| 730. | 2170 | H1 | GGCTACACCTTCACACGGTATACT | -1 |
| 731. | 2170 | H3 | ARYYDDHYCLDY | A97-Y108 |
| 732. | 2170 | H3 | GCAAGTACTATGACCATCATTACTGTCTGGATTAT | -1 |
| 733. | 2170 | H2 | INPSRGYT | I51-T58 |
| 734. | 2170 | H2 | ATTAACCCTTCCCGAGGCTACACC | -1 |
| 735. | 2170 | VL | DIQLTQSPAIMSASPGEKVTMTCRASSSVSYMNWYQQKSGTSPKRWIYDTSKVASGVPYRPSGSGSTSYSLTISSMEAEDAATYYCQQWSSNPLTFGAGTKLELK | D138-K243 |
| 736. | 2170 | VL | GATATCCAGCTGACCCAGTCCCCAGCAATTATGTCCGCCTCTCCCGGCGAGAAAGTGACTATGACCTGCCGAGAAAGTAGTAGAGTTCAGTGAGCTACATGAACTGGTATCAGCA GAAATCAGGCACCAGCCCTAAGAGATGGATCTACGACACATCCAAGGTGCGCTTCTGGGGTCCCTTATAGGTTCAGTGGGTCAGGAAGACTCAGGCACTTCCTACTCTCTGACCA TTAGCTCCATGGAGGCAGAAGATGCCGCTACATACTATTGTCAGCAGTGGTCTAATCACTGTCAGCATTTGGGGCCGGAACTAAACTGGAGCTGAAG | -1 |
| 737. | 2170 | L1 | SSVSY | S164-Y168 |
| 738. | 2170 | L1 | AGTTCAGTGAGCTAC | -1 |
| 739. | 2170 | L3 | QQWSSNPLT | Q225-T233 |

TABLE YY-continued

| SEQ ID No. | Clone | Description | Sequence | |
|---|---|---|---|---|
| 740. | 2170 | L3 | CAGCAGTGGTCTAGTAATCCACTGACA | -1 |
| 741. | 2170 | L2 | DTS | D186-S188 |
| 742. | 2170 | L2 | GACACATCC | -1 |
| 743. | 2170 | CH2 | APELLGGPSVFLFPPKPKDTLMISRTPEVTCVVVDVSHEDPEVKFNWYVDGVEVHNAKTPREEQYNSTYRVVSVLTVLHQDWLNGKEYKCKVSNKALPAPIEKTISKAK | A261-K370 |
| 744. | 2170 | CH2 | GCACCAGAACTGCTGGGAGGACCTAGCGTGTTCCTGTTCCACCCAAACCAAAGGATACACTGATGATCAGCCGACCCCTGAGGTCACATGCGTGGTCGTGGACGTCG TGTCAGTCCTGACCGTGCTGCATCAGGATTGGCTGAACGGGAAGGAGTACAAATGCAAGGTGTCCAACAAGGCCCTGCCTGCCCCAATCGAGAAGACCATTTCTAAAGC AAAG | -1 |
| 745. | 2170 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G371-G476 |
| 746. | 2170 | CH3 | GGCCAGCCCCGAGAACCTCAGGTCTACGTGTATCCTCCAGTCAGGGACGAGCTGACCAAGAACCAGGTCTCTCTGACATGTCTGGTGAAGGGGTTTTATCCATCGATAT TGCTGTGGAGTGGGAAAGTAATGGACAGCCCGAGAACTACAAGACCACTCCCCCTGTGCTGGACTCCGATGGATCTTTCGCTCTGGTCAGCAAGCTGACAGTGGAC AAGTCCAGATGCAGCAGGGCAACGTCTTTAGTTGTTCAGTGATGCACGAGGCACTGCACAATCATTACACTCAGAAAAGCCTGTCCCTGTCTCCCGGC | -1 |
| 747. | 2170 | Full | DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYDDHYCLDYWGQG TTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTIISMEAEDAATYYCQ QWSSNPLTFGAGTKLELKAAEPKSSDKTHTCPPCPAPEAAGPSVFLFPPKPKDTLMISRTPEVTCVVVDVSHEDPEVKFNWYVDGVEVHNAKTPREEQYNSTYRVVSVLTVL HQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVF SCSVMHEALHNHYTQKSLSLSPGK | -1 |
| 748. | 2170 | Full | GACATCAAACTGCAGCAGAGCGGAGCGAGCTGGCTCGACCAGGAGCAGGTCGCTGAAATGTCTGAAAATGTCATGCAAGACTCAGTTGAAGACGAAGTTTAAAGACAAGGCAACTCTGACCA GATAAGAGCTCTCTACGGTCACTGTCAGCTGAGTCCGGAGAGGAGAGTCTCCGAGAGGCTCCCTCTAGTTCAGTGGGTCAGTGAGCCGCCGCCTCAGTTCAGGATGGATACATCAGCTGAGTCTCAGATCAGATCAGCAGAATTAGCTCAGAGGCTGAAGAT GGACAGGGCACTACCCCTGACTGTCAGCTCCGTGAGGAGGAGGCTCCGAGAGCCTCTAGTTCAGTGGGTCAGTGGGCAGGAACCAAACTGGACGCTGAAGGAGTACAAATGCAAAGTGTCCAACAAGGCC AGTCTATTATGTCCGATCACTGACGTCCTCCGGGTGCCTTCAGTGGGTCAGTGGGCAGGAACCAAACTGGACGCTGAAGGAGTACAAATGCAAAGTGTCCAACAAGGCC GCCGATCATACTATTGTCAGCTGTCTAGTAATCACTGACTTTTGGGGCAGGAACCAAACTGGACGCTGAAGGAGTACAAATGCAAAGTGTCCAACAAGGCCCTGCCTG CCTGCCCCACCTTGTCCTGCAGCGTGAGCTGCCACGGAGCCCCGAAGTCAAGTTCAACTGGTACGTGGACGGCGTGGAAGTGCATAATGCCAAGACCAAGCCGCGGGA GTGGTCGTGGACGTGAGTCATGAGGATCCTGAAGTCAAGTTCAACTGGTACGTGGACGGCGTGGAAGTGCATAATGCCAAGACCAAGCCGCGGGA AGTACATATAGAGTCGTGTCAGATTTCTTAAAGCAAAGGCCAGCCCCGAACCTGACCGTGTCAGTCCATCGATATGCTGTCCATCCGGGACGAGCTGACCAAGAACCAGGTCTCTCTGACATGTCTGGTGAAGG GGGTTCTTACCCATCTGATATTGCTGTGGAGTGGGAAAGTAATGGACAGCCCGAGAACTACAAGACCACTCCCCCTGTGCTGGACTCCGATGGATCTTTCTTTCTGTAC AGCAAACTGACTGTGACAAGTCCAGATGCAGTCCAGAACGTCTTTTAGTTGTTCAGTGATGCACGAGGCACTGCACAATCATTACACCCAGAAAAGCCTGTCCCTGTC TCCCGGCAAG | -1 |
| 749. | 1890 | VH | DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYDDHYCLDYWGQG TTLTVSS | D1-S119 |
| 750. | 1890 | VH | GACATCAAACTGCAGCAGAGCGGAGCGGAGCTGGCTCGACCAGGAGCCAGTGTGAAGATGTCATGCAAGACTTCACCTGCTACACATTCACTCGGTATACAATGCACTGG GTGAAGCAGAGACCAGGACAGGGACTGGAATGGATCGGATATATTAACCCTCAGGAGGTGGAACCAACAACCAGAAGTTCAAAGACAAGGCCACACTGACCACA | -1 |

TABLE YY-continued

| SEQ ID No. | Clone | Description | Sequence | |
|---|---|---|---|---|
| | | | GATAAGAGCTCCTCTACCGCCTACATGCAGCTGAGTTCACTGACTGAGTTCACTGACAGTGAGGACTCAGCCCGTGTACTATTGCGCTAGGTACTATGACGATCATTACTGTCTGGATTATTGG GGACAGGGCACTACCCTGACTGTCAGCTCC | |
| 751. | 1890 H1 | GYTFTRYT | | G26-T33 |
| 752. | 1890 H1 | GGCTACACATTCACTCGGTATACA | | -1 |
| 753. | 1890 H3 | ARYYDDHYCLDY | | A97-Y108 |
| 754. | 1890 H3 | GCTAGGTACTATGACGATCATTACTGTCTGGATTAT | | -1 |
| 755. | 1890 H2 | INPSRGYT | | I51-T58 |
| 756. | 1890 H2 | ATTAACCCTTCCCGAGGCTACACA | | -1 |
| 757. | 1890 VL | DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK | | D138-K243 |
| 758. | 1890 VL | GATATCCAGCTGACCCAGTCCCCAGCTATTATGTCCGCATCTCCCGGCGAGAAAGTCACCATGACATGCCGCGCCTCTAGTTCAGTGAGCTACATGAACTGGTATCAGCA GAAATCAGGCACTAGCCCCAAGAGATGGATCTACGACATCCAAGGTCGCTTCGGGGTCGGAGGATCCGGCACCTCCTACTCTCTGACAA TTAGCTCCATGGAGGCTGAAGATGCCGCTACCTACTATTGTCAGCAGTGGTCTAGTAATCCACTGACTTTTGGGGCAGGAACCAAACTGGAGCTGAAG | | -1 |
| 759. | 1890 L1 | SSVSY | | S164-Y168 |
| 760. | 1890 L1 | AGTTCAGTGAGCTAC | | -1 |
| 761. | 1890 L3 | QQWSSNPLT | | Q225-T233 |
| 762. | 1890 L3 | CAGCAGTGGTCTAGTAATCCACTGACT | | -1 |
| 763. | 1890 L2 | DTS | | D186-S188 |
| 764. | 1890 L2 | GACACCTCC | | -1 |
| 765. | 1890 CH2 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | | A261-K370 |
| 766. | 1890 CH2 | GCACCAGAGAGCTGCAGGAGGACCTAGCGTGTTCCTGTTCCACCCAAACCAAAGGATACACTGATGATCAGCCGGACGCGGAAGTCACCTGAGGTCACTTGCGTGGTCGTGGACGTGA GCCACGAGGACCCCGAAGTCAAGTTCAACTGGTACGTGGACGGCGTCGAAGTGCATAATGCCAAGACAAAGCCAAGGGAGGAACAGTACAATAGTACATATGAGAGTCG TGTCAGTGCTGACCGTCCTGCATCAGGATTGCTGAACGGGAAGGAGTACAAATGCAAGGTGTCCAACAAGGTCCTGCCCCAATCGAAGACCATTTCTAAAGC AAAG | | -1 |
| 767. | 1890 CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | | G371-G476 |

TABLE YY-continued

| SEQ ID No. | Clone | Description | sequence | |
|---|---|---|---|---|
| 768. | 1890 | CH3 | GGCCAGCCCCGAGAACCTCAGTCTGCCTCCATCCGGACGAGCTGACCAAAAACCAGTCCTCTCTGTCTGTGAAGGGGTTCTACCCATCTGATAT TGCTGTGGAGTGGGAAAGTGCAGGGCAACGTCTTTAGTGTTCAGTGATGCGAGGCCGTGGACTGTGCTGGACAAACTGACTGTGGACA AGTCCAGATGGCAGCAGGGAAGTGTTCAGTGATGAT | -1 |
| 769. | 2171 | Full | QIVLTQSPAIMSASPGEKVTMTCSASSSVSYMNWYQQKSGTSPKRWIYDTSKLASGVPAHFRGSGSGTSYSLTISGMEADDAATYYCQQWSSNPFTFGSGTKLEINGGGSGG GGSGGGGSQVQLQQSGGAELARPGASVKMSCKASGYTFTRYTMHWVKQRPGQGLEWIGYINPSRGYTNYNQKFKDKATLTTDKSSSTAYMQLSSLTSEDSAVYYCARYYDHY SLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYVPPSRDELTKNQVSLTCLVKGFYPSDIAVEWESNGQPENNYKTTPPVLDSDGSFALVSKLITVDKSRWQQGNVFSCSV MHEALHNHYTQKSLSLSPGK | -1 |
| 770. | 2171 | Full | CAGATCGTCCTGACACAGAGCCCAGCAATCATGTCAGCCAGCCCCGGCGAGAAGTCACCATGACATGTTCAGCCAGCTCCTCTGTGAGCTACATGAACTGGTATCAGCA GAAAAGCGGAACATCCCCCAAGCGGTGGATCTACGACACTTCCAAGCTGGCTTCTGGAGTCCCAGCGCGTTCCACACATTTGGATCTGGGACTAGTTATTCACTGACC ATTTCCGGCATGGAGGCCGAAGATGCCGCTACATACTATTGCCAGCAGTGGAGTTCAAACCCGTTCACTTTTGGATCTGGGACTAAGCTGGAAATTAATGCGGAGGAG GCTCCAGGCGGAGGAGGAAGCGGAGGTGGAGGCTCCGGCGGAGGTGGAAGCCAGGTGCAGCTCCAGCAGAGCGGAGGCGCAGAGCTGGCTAGGCCTGGAGCAAGTGTGAAAATGTCCTGTAAGGC CAGCGGCTACACTTTCACCCGATACACCATGCATTGGGTAAAGCAGAGACCCGGGGAACAGGGCCTGGAGTGGATTGGCTACATTAATCCTTCCCGAGGATACAAACTAC AACCAGAAGTTTAAGGACAAGGCTACACTCACTGACAAGTCCTCCAGCACAGCATATATGCAGCTGAGTTCACTGACCTCTGAGGATTCTGCAGTCTATTACTGTGCGC TTGTCCAGCACCCAGAGTGCTGTGGAGGAACCTACGGCTGTTTCCACCAAAGGATCACTGATGATCTCCCGGAACACTGAGATCTCCAAGGCAAAGGGCCAGCCCAG GACGTGTCTCACGAGGACGCCTGTCCTGACCGTGCTGGTGAAGGGCCTGTATCCATCCAGACGGATCGCTGACGTGGAGTGGGAATCCAATGGGCAGCCGGAGAACAACTATAAGACCACACCC CAAAGCAATATTCTGTGAGTGGGAATCCAATGGGCAGCCCGAAAACAATTATAAGACAACACCACCCCCGGTGCTGGACTCTGACGGCTCTTCAGTCTTGCGTCCTCAGTAAAC TGACTGTGGACAAGTCACGGTGGCAGCAGGGCCAACGTCTTTAGCTGTTCCGTGATGCATGAGGCTCTGCACAATCATTACACCCAGAAATCTCTAGTCTGTCACCGGC AAG | -1 |
| 771. | 2171 | VL | QIVLTQSPAIMSASPGEKVTMTCSASSSVSYMNWYQQKSGTSPKRWIYDTSKLASGVPAHFRGSGSGTSYSLTISGMEADDAATYYCQQWSSNPFTFGSGTKLEIN | Qi-N106 |
| 772. | 2171 | VL | CAGATCGTCCTGACACAGAGCCCAGCAATCATGTCAGCCAGCCCCGGCGAGAAGTCACCATGACATGTTCAGCCAGCTCCTCTGTGAGCTACATGAACTGGTATCAGCA GAAAAGCGGAACATCCCCCAAGCGGTGGATCTACGACACTTCCAAGCTGGCTTCTGGAGTCCCAGCGCGTTCCACACATTTGGATCTGGGACTAGTTATTCACTGACC ATTTCCGGCATGGAGGCCGAAGATGCCGCTACATACTATTGCCAGCAGTGGAGTTCAAACCCATTCACA | -1 |
| 773. | 2171 | L1 | SSVSY | S27-Y31 |
| 774. | 2171 | L1 | TCCTCTGTGAGCTAC | -1 |
| 775. | 2171 | L3 | QQWSSNPFT | Q88-T96 |
| 776. | 2171 | L3 | CAGCAGTGGAGTTCAAACCCATTCACA | -1 |
| 777. | 2171 | L2 | DTS | D49-S51 |
| 778. | 2171 | L2 | GACACTTCC | -1 |
| 779. | 2171 | VH | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYDDHYSLDYWGQ GTTLTVSS | Q122-S240 |
| 780. | 2171 | VH | CAGGTGCAGCTGCAGCAGAGCGGAGCTGAGCTGGCACGACCAGGAGCCAGTGTCAAGATGTCCTGTAAGGCCAGCGGCTACACTTTCACCCGGTATACCATGCATTGG GTGAAACAGAGACCAGGACAGGGCCTGGAGTGGATCGGTTACATTAATCCTTCCCGAGGATACACAAACTACAACCAGAAGTTTAAAGACAAGGCTACCCTGACCACA | -1 |

TABLE YY-continued

| SEQ ID No. | Clone | Description | Sequence | |
|---|---|---|---|---|
| | | | GATAAGAGCTCCTCTACAGACATATATGCAGTGAGTCACTGACTTCTGAGGACAGTGCCGTAGTACTATGACGATCACTACTCCCTGGATTATTGG GGCCAGGGGACTACCCTGACCGTGAGCTCC | -1 |
| 781. | 2171 | H1 | GYTFTRYT | G147-T154 |
| 782. | 2171 | H1 | GGCTACACTTTCACCCGGTATACC | -1 |
| 783. | 2171 | H3 | ARYYDDHYSLDY | A218-Y229 |
| 784. | 2171 | H3 | GCTAGGTACTATGACGATCACTACTCCCTGGATTAT | -1 |
| 785. | 2171 | H2 | INPSRGYT | I172-T179 |
| 786. | 2171 | H2 | ATTAATCCTTCCCGAGGATACACA | -1 |
| 787. | 2171 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A258-K367 |
| 788. | 2171 | CH2 | GCACCAGAGCTGCTGGGAGGACCTAGCGTTCTGTTCCCTCCAAAACAAAGGATACACTCAAGGATATCTCCCGGACCCCTGAGGTCACATGTCGTGGTGGACGTGTC TCACAGAGGACCTGAAGTCAAGTTCAACTGGTACGTGGACGGCGTCGAGGTGCATAATGCCAAGACTAAGCCCAGGGAGGAGCAGTACAACAGCACCTATCGCGTCGTG TCTGTCCTGACCGTGCTGCACCAGGATTGGCTGAACGGCAAGGAGTACAAGTGCAAGGTCTCCAATGAGAAGGCCCTGCCTGCCCCAATCGAGAAGACCATTAGCAAGGCAA AG | -1 |
| 789. | 2171 | CH3 | GQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G368-G473 |
| 790. | 2171 | CH3 | GGGCAGCCCCGAGAACCCAGTGTACACCCTGCCCCCATCTCGGGACGAGCTGACCAAGAACCAGGTCAGTCTGACATGTCTGGTGAAGGCTTTTACCCAAGCGATAT TGCTGTGGAGTGGAATCCAATGGACAGCCCGGAAACTATAAGACAACTCCCCCCTGTCCTGGACAGCGATGGGAGCTTCAGTAGCCTCGTCAGTAAACTGACTGTGGAC AAGTCACGGTGGCAGCAGGGCAACGTCTTTAGCTGTTCCGTGATGCATGAGGCTCTGCACAATCATTACACCCAGAAATCTCAGTCTCTGAGTCTGTCACCCGGC | -1 |
| 791. | 3300 | Full | DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSPYTFGQGTKLEIKRTV AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | -1 |
| 792. | 3300 | Full | GACATTGTGATGACACAGTCCCCTGACTCTCTGGCTGTCCTGTCCCTGGGCGAGCGAGCCAACATCAATTGCAAGAGCTCCCAGTCCGTCCTGAACTCCGGAAATCAGAAAA CTATCTGACCTGGTACCAGCAGAAGCCCGGACAGCCCCCTAAGCTGCTGATCTATTGGGCTAGTACCCGGGAGTCAGGGGTCCCAGAGCGGTTCAGTGGCTCAGGGAGC GGAACAGATTTTACCCTGACAATTTCCACCCTGCAAGCTGAAGATGTGGCCGTGTACTATTGCCAGAGTGACTACTCATATCCTTACACATTCGGCCAGGGAACTAAGCT GGAGATCAAAAGGACTGTGGCCGCTCCATCTGTCTTCATTTTTCCACCCTCCGACGAACAGCTGAAGTCCGGCACAGCCTCTGTGGTCTGTCTGCTGAACAATTTTTATCC ACGCGAGGCCAAGGTGCAGTGGAAGGTCGATAATGCTCTGCAGAGCGGAAACAGCCAAGAGTCAGTGACCGAACAGGACAGTAAGGATTCAACATACAGCCTGTCAAG CACTCTGACCCTGTCTAAAGCAGATTATGAGAAGCACAAAGTGTACGCCTGCGAAGTCACTCATCAGGGACTCTCCTCCCCTGTCACCAAGAGCTTCAACAGGGGCGAAT GT | -1 |
| 793. | 3300 | VL | DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSPYTFGQGTKLEIK | D1-K113 |

TABLE YY-continued

| SEQ ID No. | Clone | Description | Sequence | |
|---|---|---|---|---|
| 794. | 3300 | VL | GACATTGTGATGACACAGTCCCTGACTCTCTGGCTGTCCTGTGTCCCTGGCGAGCGAGCAACATCAATTGCAGAGAGCTCCCAGTCCGTCCTGAACTCTGGAATCAGAGAAAAA CTATCTGACCTGGTACCAGCAGAAGCCGGACAGCCGGAAGCTCTTAATCTGTGATTATGCCGTCTAGTAGCCAGGAGGTGCCTGACAGATTCAGTGGCTCAGGAGC GGAACAGATTTTACCCTGACAATTTCTAGTCCAGGAGACTGGCCTCTACTATTGCCAGAGTGATTACTCATATCCTTACACATTCGGCCCAGGGGACTAAGCT GGAGATCAAA | -1 |
| 795. | 3300 | L1 | QSVLNSNQKNY | Q27-Y38 |
| 796. | 3300 | L1 | CAGTCCGTCCTGAACTCTGGGAATCAGAAAAACTAT | -1 |
| 797. | 3300 | L3 | QSDYSYPYT | Q95-T103 |
| 798. | 3300 | L3 | CAGAGTGATTACTCATATCCTTACACA | -1 |
| 799. | 3300 | L2 | WAS | W56-S58 |
| 800. | 3300 | L2 | TGGGCTAGT | -1 |
| 801. | 3300 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R114-C220 |
| 802. | 3300 | CL | AGGACTGTGGCCGCTCCAAGTCTTCATTTTTCCACCCTCGAGAGCGGAACTCTGCAGAGTGTGTGCCTGCTGAACAATTTTTATCCACGCGAGGCC AAGGTGCAGTGGAAAGTGGATAATGCTCTGCAATCTGGGAACTCAGGGAGTCTCAGGAGCGAGAGGACAGGAGGACTAAGGAATCAACATACAGCCGTCTGACACTCTGACC CTGTCTAAAGCAGATTATGAGAAGCACAAAGTGTACGCCTGTGAAGTCACTCATCAGGGACTGTCCTCTCCCGTGACCAAGAGCTTCAACAGAGGCGAATGT | -1 |
| 803. | 2305 | Full | QVQLQQSGAELVRPGSSVKISCKASGYAFSSYWMNWVKQRPGQGLEWIGQIWPGDGTNYNGKFKGKATLTADESSSTAYMQLSSLASEDSAVYFCARRETTTVGRYYYAM DYWGQGTTVTVSSASTKGPSVFPLAPDSKSTSGGTAALGCLVKDYFPEPVTVSWNSGALTSGVHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEK TISKAKGQPREPQVYTLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK | -1 |
| 804. | 2305 | Full | CAGGTTCAGCTGCAGCAGAGCGGAGCGAACTGGTCAGACCCGGCAGCTCAGCATTCTCAGGCTTCAGGCTATGCAATTCTAGTTACTGGATGAACTGGGCT TGAAGCAGAGGCCTGGGCAGGGCTCCACGGCCTCACCGCCGTCTTCAAGGCGATGGAATGCCGTAGTCCGTCATCTGAAGCCGAAGGCCGCTACTATTA CGCTATGGACTATTGGGGCCAAGGAACAACAGTCACAGTTCAGCTCGGCCTCCACCAAGGGCCCATCGGTCTTCCCCCTGGCACCCTCCTCCAAGAGCACCTCTGGGGGC ACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTA CAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTG GACAAGAAAGTTGAGCCCAAATCTTGTGATAAAACTCACACATGCCCACCGTGCCCAGCACCTGAACTCCTGGGGGGACCGTCAGTCTTCCTCTTCCCCCCAAAACCCAAG GACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAAT GCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGT GCAAGGTCTCCAACAAAGGCCTCCCAGCCCCCATCGAGAAAACCATCTCCAAAGCCAAAGGGCAGCCCCGAGAACCACAGGTGTACACCCTGCCCCCATCCCGGGATGAGCTG ACCAAGAACCAGGTCAGCCTGACCTGCCTGGTCAAAGGCTTCTATCCCAGCGACATCGCCGTGGAGTGGGAGAGCAATGGGCAGCCGGAGAACAACTATAAGACCACGCCT CCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAG GCTCTGCACAATCACTACACCCAGAAGTCACTCTCCCTGTCTCCGGGCAAG | -1 |
| 805. | 2305 | VH | QVQLQQSGAELVRPGSSVKISCKASGYAFSSYWMNWVKQRPGQGLEWIGQIWPGDGTNYNGKFKGKATLTADESSSTAYMQLSSLASEDSAVYFCARRETTTVGRYYYAM DYWGQGTTVTVSS | Q1-S124 |

TABLE YY-continued

| SEQ ID No. | Clone | Description | Sequence | |
|---|---|---|---|---|
| 806. | 2305 | VH | CAGGTCCAGCTGCAGCAGAGCGGAGCCGAACTGGTCAGAGCCGGCAGCCTCCGTGAAATCAGTTGCAAGGCTTCAGGCTATGCATTCTAGTTACTGGATGAACTGGG TGAAGCAGAGGCCTGGGCAGGGACTGGAATGATCGGGCAGCCGCCTTATGACAGTCGGGCAGCACGAGAAGGCCACTCTGACCGCT GACGAGTCAAGCTCCACCGCCTATTGGGACAGGGCACCAGGCACCACAGTCACTGTCAAGC CGCTATGGACTATTGGGGACAGGGCACCAGGCACCACAGTCACTGTCAAGC | -1 |
| 807. | 2305 | H1 | GYAFSSYW | G26-W33 |
| 808. | 2305 | H1 | GGCTATGCATTCTAGTTACTGG | -1 |
| 809. | 2305 | H3 | ARRETTVGRYYAMDY | A97-Y113 |
| 810. | 2305 | H3 | GCTCGGAGAGAAACCACAACTGTGGGCCGCTACTATTACGCTATGACTAT | -1 |
| 811. | 2305 | H2 | IWPGDGDT | I51-T58 |
| 812. | 2305 | H2 | ATTTGGCCAGGCGACGGGGATACT | -1 |
| 813. | 2305 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A125-V222 |
| 814. | 2305 | CH1 | GCTAGCACCAAAGGGCCTTCCGTGTTTCCACTGGCACCCTCTAAGAGCACTTCCGGAGGAACCGCAGCTCTGGGATGTCTGGTGAAGGATTACTTCCCAGAGCCCGT CACAGTGTCATGGAACAGCGGAGCCCTGACCAGCGGAGTCCACACATTTCCTGCCGTCCTGCAGAGTCAGGCTGTGCTCACAGTGCCATCTA GTTCACTGGGGACACAGACTTACATCTGCAACGTGAATCACAAACCATCCAATACTAAGGTCGACAAGAAAGTG | -1 |
| 815. | 2305 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | -1 |
| 816. | 2305 | CH2 | GCTCCAGAGCTGCTGGGAGGACCAAGCGTGTTCCTGTTTCCACCCAAACCTAAGGACACTCTGATGATTAGCCGAACACCAGAAGTCACTTGCGTTGTGGTCGGACGTGA GCCACGAGGACCCCGAAGTCAAGTTCAACTGTACGTGGATGGGGTCGAGGTGCATAATGCCAAGACCAAGCCCAGGGAGGAACAGTATAATTCTACATACCGCGTCG TGAGTGTCCTGACTGTCCTGCACCAGGACTGGCTGAACGGAAAGGAGTACAAATGCAAGGTGTCCAACAAGGCACTGCCCGCCTATCGAAGAGACCATTTCTAAAGC AAAG | -1 |
| 817. | 2305 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G348-G453 |
| 818. | 2305 | CH3 | GGCCAGCCTCGAGAACCACAGGTCTATGTGCTGCCTCCAAGTCGGGACGAGCTGACAAAGAACCAGGTCAGCCTGCTCTGCCTGGTGAAGGGGTTCTACCCCTCCGATA TTGCCGTGGAGTGGGAATCTAATGGACAGCCTGAAAACAATTATCTGACCTGGCCCCCTGTGCTGGACTCCGATGGATCTTTCTTCTGTACTCAAAACTGACAGTGGATA AGAGCAGGTGGCAGCAGGGCAACGTCTTTTCTGTAGTGATGCATGAGGCCCTGCACAATCATTACACCCAGAAATCACTGAGCCTGTCCCCCGGC | -1 |
| 819. | -2 | Full | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIF | -1 |
| | | | PPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | |
| 820. | -2 | Full | GACATCCAGATGACCCAGTCTCCATCCTCCCTGTCTGCATCTGTAGGAGACAGAGTCACCATCACTTGCCGGGCAAGTCAGGACGTTAACACCGCTGTAGCTTGGTATCA GCAAAACCAGGAAAGCCCCCTAAGCTCCTGATCTATTCTGCATCATTTCTGTACTGTCAACTTACTATCCCCAACTGTACAGGGTCCCATCAAGGTCCAAGGACAGATTTCACTCTCAC CTGCACCATCGGGCAAGCAGCTGGAGCCCTGCCCATCTCCCGGCCATCTGATGAAGCAGTTGAAATCTGAAACTGCACTCCGTCTGTGTCCTGCGTCAACAGCACCACCACCACCACCACCTGCTGAAATAACTCTATCCAGAGCGCAAACCACTCCACCACCAGCAGGACCAGCAGCAGCAGCAGCACCCTCAGCAGACGTTCAACAGGAGCTTACCACAAGACTTCAACGGGAGAGTGT GGAAGGTGGATAACGCCCTCCAATCGGATAACTCCCAAGAGTCACAAGAGAGACCTCAAAAGAGCACCTACAGCCTCAGCAGCACCCTGACGCTGAGCAAG CAGACTACGAGAAACACAAAGTCTACGCCTGCGAAGTCACCCATCAGGGCCTGAGCTCGCCCGTCACAAAGAGCTTCAACAGGGGAGAGTGT | -1 |

TABLE YY-continued

| SEQ ID No. | Clone | Description | sequence | |
|---|---|---|---|---|
| 821. | -2 | VL | DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK | D1-K107 |
| 822. | -2 | VL | GACATCCAGATGACCCAGTCTCCATCTCCCCTGTCTGCATCTGTAGGAGACAGAGTCACCATCACTTGCCGGGCAAGTCAGGACGTTAACACCGCTGTAGCTTGGTATCAGCAGAAACCAGGGAAAGCCCCTAAGCTCCTGATCTATTCTGCATCCTTTTTGTACAGTGGGGTCCCATCAAGGTTCAGTGGCAGTGGATCTGGGACAGATTTCACTCTCACCATCAGCAGTCTGCAACCTGAAGATTTTGCAACTTACTACTGTCAACAGCATTACACTACCCCACCCACTTTCGGCCAAGGGACCAAAGTGGAGATCAAA | -1 |
| 823. | -2 | L1 | QDVNTA | Q27-A32 |
| 824. | -2 | L1 | CAGGACGTTAACACCGCT | -1 |
| 825. | -2 | L3 | QQHYTTPPT | Q89-T97 |
| 826. | -2 | L3 | CAACAGCATTACACTACCCCACCCACT | -1 |
| 827. | -2 | L2 | SAS | S50-S52 |
| 828. | -2 | L2 | TCTGCATCC | -1 |
| 829. | -2 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R108-C214 |
| 830. | -2 | CL | CGAACTGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAAGAGGAGTGTCACAGACAGGACAGCGGCGGACAGCAGGACAGCACAGGTCCGCCGTCACGAGCGGCCTCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT | -1 |
| 831. | 5238 | Full | QIVLTQSPAIMSASPGEKVTMTCSASSSVSYMNWYQQKSGTSPKRWIYDTSKLASGVPAHRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDRATLTTDK5SSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 832. | 5238 | Full | CAGATCGTCCTGACACAGAGCCCAGCAATCATGTCAGCCCAGCCCCGGCGAGAAAGTCACAATGACTTGCTCAGCAAGCTCCTCTGTGAGCTACATGAACTGGTATCAGCAGAAAACGCAGGAACCTCCCCAGAGCGAAGCTGGATCTACGACACAGCCTCCAGAGCCAGCCAGCTGCACAAGAGACACATTCGGCCATCAGCAAGTTCAGCGGTCGGCTATCCTGGGTCACTCTGGCATCAGAGCGGCAGCAGCTGGAAGAGGAACGGGAGAAATGCGGAGGAGAACTCCAAGAGCCAAGCTGAAAATGTCCTGTAGGCACCCGGCTACACCTTCACACGGTACACCATGCACTGGGTGAAATGGCAGGCTCGCAGGACCGGGCTACAAACCTACACCAGAGTTAAGACAAGGCTACTCTGACCACAGATAGAGTCTCCTTCCACCCGGACATATGAGAACCCCAGGGGAGTCACCTGACCACAGACCACAGATATCTCCGACACCCAAGGGATATCTGCGCGACAAGTTTAAGGATCGAGCTAGCAACAGAATCCTAGTCACACCCAAGAAATTAACCCCATTCCACAGATCTTCCACCAAACCAAAGGAATCTCCTGTTTCACCACCGGACGGGCCAGGAACAGTACAACTCCATATCGCTGTCTGTCCTGCCTCGAGGAATCCTGCAGAACAGAATAAATGCAAGAGAGAACAGGTAGACTCCTCTGAAGGGCCTCATCTGGTGTCTGGACGTGTCTGTACGTGGAACGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGATGAGCTGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCTGAGTCTGTCTCCACCGGC | -1 |
| 833. | 5238 | VL | QIVLTQSPAIMSASPGEKVTMTCSASSSVSYMNWYQQKSGTSPKRMIYDTSKLASGVPAHRGSGSGTSYSLTISGMEAEDAATYYCQQWSSNPFTFGSGTKLEIN | Q1-N106 |

TABLE YY-continued

| SEQ ID No. | Clone | Description | Sequence | |
|---|---|---|---|---|
| 834. | 5238 | VL | CAGATGCTCTGACACAGAGCCCAGCAATCATGTCAGCAGACCCCAGCAATGACTTGTCAGCAGCAGCAGCTCCTCTGAGCTACATGAACTGGTATCAGCAGAAAAGGGAACCTCCCCAGAGATGATCTACGACACATCCAAGCTGGCTTCTGAGTGCCTGACACTTGAGTTATTCACTGACAATTCCGGCATGGAGGCTGAAGATGCCGCTACATACTATTGCCAGCAGTGGAGTTCAAACCCATTCACTTTTGGATCTGGCACCAAGCTGGAAATTAAT | -1 |
| 835. | 5238 | L1 | SSVSY | S27-Y31 |
| 836. | 5238 | L1 | TCCTCTGTGAGCTAC | -1 |
| 837. | 5238 | L3 | QQWSSNPFT | Q88-T96 |
| 838. | 5238 | L3 | CAGCAGTGGAGTTCAAACCCATTCACT | -1 |
| 839. | 5238 | L2 | DTS | D49-S51 |
| 840. | 5238 | L2 | GACACATCC | -1 |
| 841. | 5238 | VH | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS | Q122-S240 |
| 842. | 5238 | VH | CAGGTGCAGCTGCAGCAGTCCGGAGCTGAGCTGGCACGACCAGGAGCAAGTGTGAAAATGTCCTGTAAGGCCAGCGGCTACACCTTCACACGGTATACCATGCATTGGGTGAAACAGAGACCCGGCCAGGGACTGGAATGGATCGGATACATTAATCCTAGCCGAGGATACAACTACAACCAGAAGTTTAAAGACAAAGCTACTCTGACACAGATAAGAGCTCCTCTACCGCATATATGCAGCTGAGTTCACTGACATCGCTGTATTGCGCAGGTACTATGACGATCACTACTACTGTCTGGATTATTGGGGCCAGGGGACTACCCTGACCGTGAGCTCC | -1 |
| 843. | 5238 | H1 | GYTFTRYT | G147-T154 |
| 844. | 5238 | H1 | GGCTACACCTTCACACGGTATACC | -1 |
| 845. | 5238 | H3 | ARYYDDHYCLDY | A218-Y229 |
| 846. | 5238 | H3 | GCTAGGTACTATGACGATCACTACTGTCTGGATTAT | -1 |
| 847. | 5238 | H2 | INPSRGYT | I172-T179 |
| 848. | 5238 | H2 | ATTAATCCTAGCCGAGGATACACA | -1 |
| 849. | 5238 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A258-K367 |
| 850. | 5238 | CH2 | GCACCAGAGCTGCTGGGAGGACCCTCCGTGTTCCTGTTTCCACCCAAACAAGGATACTCTGATGATCTCCGGACATCCCGGACATCTGAAGTCACTTGCGTCGTGGTGGACGTGTCTCACGAGGACCCCGAAGTCAACTGGTACGTGGACGGCGTGGAGGTGCATAATGCCAAAACCAAGCCCAGGGAGGAACAGTACAACTCCACATATCGCGTGTGTCTGTCCTGACGTGCTGCACCAGGATTGGCTGAACGGCAAGGAGTACAAATGCAAGGTGAGCAACAAATGCAAAGCCCTGCCTGCTCCAATCGAGAAGACAATTAGCAAAGCCAAG | -1 |

TABLE YY-continued

| SEQ ID No. | Clone | Description | Sequence | |
|---|---|---|---|---|
| 851. | 5238 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G368-G473 |
| 852. | 5238 | CH3 | GGGCAGCCCCGAGAACCTCAGGTTTACGTGCTGCCTCCATCTCGGGACGAGCTGACTAAAAAACCAGTCAGTCTGCTGTGTCTGGTGAAGGGCTTCTATCCAAGCGATA TTGCTGTGGAGTGGGAATCCAATGGGCAGCCCGGAAAACAATTACCTGGACCTGGACTCTTTCTGTATAGTAAACTGACCGTGGAC AAGTCACGTGCAGCAGGGAAACGTCTTAGCTGTTCCGTAGTGCTTCACATGCATGAGGCCCTGCACAATCATTACACCCAGAGTCTGAGTCTGTCACCCGGC | -1 |
| 853. | 2167 | Full | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGSGGG GSGGGGSGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYDDHY SLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQD WLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSV MHEALHNHYTQKSLSLSPGK | -1 |
| 854. | 2167 | Full | CAGATCGTCCTGACACAGAGCCCAGCAATCATGTCAGCAAGTCACATGACTTGCTCAGCAAGCTCTCTGTGAGCTACATGAACTGGTATCAGCA GAAAAGCGGAACCTCCCCCAAGCTGAAGATGCCGCTACCTACTGGGATTATTGGGAGAAAGTCAGCCCCAAGCGGTGGATCTGGGAGCAGCTGCCACCAAGCTGGAAGCTGGAAAATGTCCTGAAGGC GCTCCAGAGGAGGGTCTGGAGCAGGAAGTTTAAAGACACCACTTCACACGGCTACATCCATTGGGTGAAACAGAGACCGGGGACAGTCTGGTACATTAATCCTTCCGAGATACAACTAC AACCAGAAGTTTAAAGACACCACTTCACACGGCTACATCCATTGGGTGAAACAGAGACCCGGGACAGTCTGGTACATTAATCCTTCCGAGATACAACTAC TAGTACTATGCAGTGGGTCCAGGGACCACTCTCCTGATTATTGGGGACCGTGTCCAGGGACCACTCTCCTGTTTCACCAGACATAGAGCCTCCGACCCTGATGATCTCCGAAGCTGACCTGAGTCTGAGGATACTAGTGACACCTGAGTCAGGTGGTCGT GACGTGTCTCACGAGGACCCCGAAGTGAAGTTTAACTGGTACGTGGATGGTGAAGTGCATAATGCAAAACCAAGACCAAAACCCAAGGAGGAACAGTACAACTCCACATTCT CGTGTCGTGTCTGTCCTGACGGTGCTGCATCAGGAAGGCGTCTCCAATCAGGGAAGGTACGTGGATCCCATCGAGAAAACCATCAGCAAGGTCAAGGGACATAG CAAAGCCAAGGGCCAGATATTGCTGTGGAGTGGGAATCCAATGGGCAGCCCGAAAACAATTACCTGGACCTGGACCAGTCTCCTGTATAGTAAACT CCAAGCTGACAGTCGACAAGTCACGGTGCAGCAGGAGAAACGTCTTTAGCTGTTCCGTAGTGCTGCCGTTCACATGCAGAGCCCTGACAATCATTACACCCAGAGTCTGAGTCTGTCACCCGGCA AG | -1 |
| 855. | 2167 | VL | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEIN | Q1-N106 |
| 856. | 2167 | VL | CAGATCGTCCTGACACAGAGCCCAGCAATCATGTCAGCAAGTCCAGGCGAGAAAGTCACATGACTTGCTCAGCAAGCTCTCTGTGAGCTACATGAACTGGTATCAGCA GAAAAGCGGAACCTCCCCCAAGCTGCGCTGGATCTACGACACATCCAAGCTGGCCTCTGGAGTGCCAGCCCACTTCAGGGGCGCTGGATCTGGGACCAGTTATTCACTGACA ATTTCCGGCACTGGAGCTGGAGGATGCCGCTACCTACTATTGCCAGCAGTGGAGTTCAAACCCATTCACTTTTGGATCTGGGAAATTAAT | -1 |
| 857. | 2167 | L1 | SSVSY | S27-Y31 |
| 858. | 2167 | L1 | TCCTCTGTGAGCTAC | -1 |
| 859. | 2167 | L3 | QQWSSNPFT | Q88-T96 |
| 860. | 2167 | L3 | CAGCAGTGGAGTTCAAACCCATTCACT | -1 |
| 861. | 2167 | L2 | DTS | D49-S51 |
| 862. | 2167 | L2 | GACACATCC | -1 |
| 863. | 2167 | VH | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYDDHYSLDYWGQ GTTLTVSS | Q122-S240 |

TABLE YY-continued

| SEQ ID No. | Clone | Description | Sequence | |
|---|---|---|---|---|
| 864. | 2167 | VH | CAGGTCAGCTGCAGCAGAGCGGAGCTGACGACCAGGAGCCAAGTGTGAAAATGTCCTGTAAGGCCAGCGGCTACACCTTCACACGGTATACCATGCATTGG GTGAAACAGAGACCCGGGCAGGACTGGAATGATGGGTACTGGTCACTATTAATCCTTCCCGAGGATACACAAACTACACCAGAAGTTAAAGACAGGGCTACTCTGACCACAG ATAAGAGCTCCTCTACCGCAGTCAGCTGAGTTCACTGACTGAGTTCAGCCAGTCCGTGTAGCTGCTAGTACTATGCATCACTCCCCTGGATTATTGGG GCCAGGGGACTACCCTGACAGTGAGCTCC | -1 |
| 865. | 2167 | H1 | GYTFTRYT | G147-T154 |
| 866. | 2167 | H1 | GGCTACACCTTCACACGGTATACC | -1 |
| 867. | 2167 | H3 | ARYYDDHYSLDY | A218-Y229 |
| 868. | 2167 | H3 | GCTAGGTACTATGACGATCACTACTCCCTGGATTAT | -1 |
| 869. | 2167 | H2 | INPSRGYT | I172-T179 |
| 870. | 2167 | H2 | ATTAATCCTTCCGAGGATACACA | -1 |
| 871. | 2167 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A258-K367 |
| 872. | 2167 | CH2 | GCACCAGAGCTGCTGGAGAACCTAGCGTGTTCCTGTTCCACCCAAAACCAAAGGATACTCTGATGATCTCCCGACACCTGAAGTCACTTGTGTCTGTGACGTGTC TCACGAGGACCCCGAAGTCAAGTTTAACTGGTACGTGGACGGCGTCGAGGTCGATAATGCCAAAACCAAGCCCAGGGAGGAACAGTACACAACTCACATATCGCTGTCGT GTCTGTCCTGACTGTGCTGCACCAGATTGGCTAAAACGTCTTCCGTGCACCTCCAATCGAGCACCAAGGCCCTGCCTGCTCCAATCGAGAAGACAATTAGCAAGGCC AAG | -1 |
| 873. | 2167 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 874. | 2167 | CH3 | GGGCAGCCCCGAGAACCTCAGGTCTACGTGCTGCCTCCATCTCGGGACGAGCTGACTAAAAACCAGGTCAGTCTGTGTCTGTGAAGGGCTTCTATCCAAGCGATA TTGCTGAGTGGGAGTCCAATGGGCAGCCCGAAAACGTTCTTTACGTGTCCGTGATGCATGAGGCCTTGCACAACCATTACACCCAGAAATCTCGAGTCTGTCACCCGGC AAGTCACGGTGTGCAGCAGGGAAACGTCTTTAGCTGTTCCGTGATGCATGAAGCCCTGCACAATCATTACACCCAGAAATCTCGAGTCTGTCACCCGGC | G368-G473 |
| 875. | 3320 | Full | EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYW AYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPE DEAEYYCVLMYSNRWVPGGGTKLJTVLAAEPKSSDKTHTCPPCPAPEAAGGPSVFLFPPKPKDTLMISRTPEVTCVVVSVSHEDPEVKFNWYVDGVEVHNAKTKPREEQYNSTYR VVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSR WQQGNVFSCSVMHEALHNHYTQKSLSLSPGK | -1 |
| 876. | 3320 | Full | GAAGTCCAGCTGGTCGAGTCCGGAGGAGGACTGGTGCAGCCAGGAGGGTCACTGAAACTGAGCTGCGCCGCCTCCGGCTTCACTTTTAACAAGTATGCAATGAATTGG GTGCGGCAGGCACCAGGAAAGGGACTGGAATGGGTGGCCCGGATACGCTTCAAGTACAACAACTACGCTACCTACTATGCAGACAGTGTGAAGGATAGGTTCACAATT TCTCGCGACGATAGTAAAAACCTGGGCACTATGGGCATACTGCTTACCTGCACATGAACATCTGCAGATGAACAATCTGAAGACAGAGGACACAGCAGTGTACTACAT CTCCATTATTGGGCACACGGAGACCCTCACTGACATTCAGGCACGGTGTGACCCTGAGCCTCACAGTGAGCCCTGAGCCGGGTCGGTGAGCATGTGGGTGAAGGCCAGTCGCAGGTCGTGC ACCCAGGACGCAGGAGTGCGCACCCGACGATTGGAGGACATGGATGAAGTCCTGTAGGACGACCATGGTGGTGCTCGAACTTCCGGGAAAAGGAAGGCGAGCGAAGCGACTGAGCGCCCT GAGCGGAGTCCAGCTGCAGCCTGAGGATGAAGCCAGGACTATTGCGTCTGCTGGTGACAACAGCAGCAATGCCCTCAGGACTGTGCTGGCTGCAGAGC | -1 |

TABLE YY-continued

| SEQ ID No. | Clone | Description | Sequence | |
|---|---|---|---|---|
| 877. | 3320 | | CAAGTCAAGGCGACAAAACTCACACCTGCCCAGCTCCAGCTCCAGCTTGTCCAGCCTGTTCCTGTTCTCTGTTTCCACCCAGAAGATACACTGATGATCT CTCGCACTCCCGAGGTCACCTGTGTCGTCTCAAGCTCAGCTGAGTGGAAGACCAGCCCAAGCCAGCCCAAAGATACACTGATGATCT ACCTCGAGGAGACACAGTATAATTCAACTACCGGGTCGTGAGCGTCAAGTTAACTGTGACTGGAATGGCGTCGAAGTGCATAATGCCAAGACCAA GGCACTGCCTGCCCAATCGAAAAAACCATTAGCAAGGCAGCCAGTCTCCAAGCAGGGACTATCCTCCAAGCAGGACGAACTGACCAAGAACCA GTCTCCCTGACATGTCGGTGAAAGGGTTCTATCCTGACCTCCAAGCTGACAGTCCAGTGATATTGCAGTGGAGAATGGGACAATTACAAGACCACACCCCCTGTCTG GACTCTGATGGCAGTTTCGCACTGGTCTCCAAGCTGACCGTGGATAAAATCTAGGTGGCAGCAGGGAACGTCTTTAGCTGTTCCGTGATGCATGAAGCCCTGCACAATCA TTACACAGAAGTCTCTGAGTCTGTCACCCGGCAAA | E1-S125 |
| 878. | 3320 | VH | EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYW AYWGQGTLVTVSS | -1 |
| | | | GAAGTCCAGCTGGTCGAGTCCGAGGAGGACTGGTCAGCCAGGAGGGTCACTGAAACTGAGCTGCGCCGCTTCACTGAAACTGAGCTGCGCCGCTTCACTTTAACAAGTATGCAATGAATTGG GTGCGGCAGGCACCAGGAAGGGACTGGAATGGGTGGCCCGGATCAGATTCAAGATACAACAACTACGCTACCTATGCAGACAGTGAAGGATAGGTTCACAATT CTCCGCGACGATAGTAAAAACACTGCTTACCTGCAGATGAACAATCAGAGACGAACACTGCCGTGAGACACGGAAACTTTGGCAATAGCTACAT CTCCTATTGGGCATACTGGGGACAGGGAACCCTGGTCACAGTGAGCTCC | |
| 879. | 3320 | H1 | GFTFNKYA | G26-A33 |
| 880. | 3320 | H1 | GGCTTCACTTTTAACAAGTATGCA | -1 |
| 881. | 3320 | H3 | VRHGNFGNSYISYWAY | V99-Y114 |
| 882. | 3320 | H3 | GTGAGACACGGAAACTTTGGCAATAGCTACATCTCCTATTGGGCATAC | -1 |
| 883. | 3320 | H2 | IRSKYNNYAT | I51-T60 |
| 884. | 3320 | H2 | ATCAGATCTAAGTACAACAACTACGCTACC | -1 |
| 885. | 3320 | VL | QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL | Q141-L249 |
| 886. | 3320 | VL | CAGACTGTGGTCACCCAGGAGCCCTCACTGACTGTCAGCCCTGACGACGCACTGTGGAGCCACGTCTAGTACGGGCACTGGGTCTAGTACGGGCAACTATCCCAATTG GGTGCAGCAGAAACCTGAGGACTGATTGGAGGAACAAAGTTCCTGGCCCCGGAACTTCCTGCTCTCTGCGATTTTCCGGAGCGTGTTCGGAGGCGGGACAAAGCTGACTGCTG GCACTGACCCTGAGCGGAGTGCAGCCTGAGGATGAAGCCGAGTACTATTGCGTGCTGTGGTACAGCAACAGATGGGTGTTCGGAGGCGGGACAAAGCTGACTGTGCTG | -1 |
| 887. | 3320 | L1 | TGAVTSGNY | T166-Y174 |
| 888. | 3320 | L1 | ACCGGAGCCGTGACATCTGGCAACTAT | -1 |
| 889. | 3320 | L3 | VLWYSNRWV | V231-V239 |
| 890. | 3320 | L3 | GTGCTGTGGTACAGCAACAGATGGGTG | -1 |
| 891. | 3320 | L2 | GTK | G192-K194 |
| 892. | 3320 | L2 | GGAACAAAG | -1 |

TABLE YY-continued

| SEQ ID No. | Clone | Description | Sequence | |
|---|---|---|---|---|
| 893. | 3320 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A267-K376 |
| 894. | 3320 | CH2 | GCTCCAGAAGCAGCTGGAGGACCAATCCGTGTTCCTGTTTCCACCCAAGCCCAAGGACACTCTGATGATCTCTCGGACTCCCGAGGTCACCTGTGTGGTCGTGAGTGTGTCACGGAAGACCCTGAGGTCAAGTTTAACTGGTACGTGGATGGCGTCGAAGTGCATAATGCCAAGACTAAGCCAAGAGAACAGTACAATAGTACCTACCGGGTCGTGAGCGTCCTGACCGTGCTGCATCAGGACTGGCTGAATGGCAAGGAGTACAAGTGCAAGGTCTCCAACAAGGCTCTGCCCGCCCCAATCGAAAAAACCATTAGCAAGGCTAAA | −1 |
| 895. | 3320 | CH3 | GQPREPQVYVPPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G377-G482 |
| 896. | 3320 | CH3 | GGGCAGCCAAGAGAGCCCCAGGTCTACGTGTATCCTCCAAGCAGGGACGAACTGACCAAGAACCAGGTCTCCCTGACATGTCTGGTGAAGGGTTCTTATCCTAGTGATATTTGCAGTGGAATGGGAGTCAAATGGCAGCCAGAGAACAATTACAAGACCACACCCCCGTGCTGGACTCAGATGGGAGCTTCTTCCTGTCAGCGATGAAGGGTTTAAATCTAGGTGGCAGCAGGGGAACGTCTTTAGCTGTTCCGTGATGCATGAGGCCCTGCACAATCATTACACACAGAAGTCTCTGAGTCTGTCACCCGGC | −1 |
| 897. | 5241 | Full | QVQLQQSGAELVRPGSSVKISCKASGYAFSSYWMNWVKQRPGQGLEWIGQIWPGDDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDMLNGKEYKCKVSNKALPAPIEKTISKAKGQPREPQVYVLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | −1 |
| 898. | 5241 | Full | CAGGTCCAGCTGCAGCAGAGCGGAGCCGAACTGGTCAGACCAGGCAGCTCCGTGAAAATCAGTTGCAAGGCTTCAGGCTATGCATTCTCTAGTTACTGGATGAACTGGGTGAAGCAGAGGCCTGGGCAGGGCCTGGAATGGATCGGGCAGATTTGGCCTGGCGATGACACTAACTATAATGGGAAGTTCAAGGGCAAGGCCACACTGACTGCTGATGAGAGCTCAAGCACTGCATATATGCAGCTGTCTAGTCTGGCATCTGAAGACTCTGCTGTTTATTTCTGTGCCAGGAGGGAGACGACCACAGTTGGCCGTTACTACTATGCAATGGATTACTGGGGCCAAGGGACCACCGTCACCGTCTCGAGTGCTAGCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGATGAGCTGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGT | −1 |
| 899. | 5241 | VH | QVQLQQSGAELVRPGSSVKISCKASGYAFSSYWMNWVKQRPGQGLEWIGQIWPGDDTNYNGKFKGKATLTADESSSTAYMQLSSLASEDSAVYFCARRETTTVGRYYYAMDYWGQGTTVTVSS | Q1-S124 |
| 900. | 5241 | VH | CAGGTCCAGCTGCAGCAGAGCGGAGCCGAACTGGTCAGACCAGGCAGCTCCGTGAAAATCAGTTGCAAGGCTTCAGGCTATGCATTCTCTAGTTACTGGATGAACTGGGTGAAGCAGAGGCCTGGGCAGGGCCTGGAATGGATCGGGCAGATTTGGCCTGGCGATGACACTAACTATAATGGGAAGTTCAAGGGCAAGGCCACACTGACTGCTGATGAGAGCTCAAGCACTGCATATATGCAGCTGTCTAGTCTGGCATCTGAAGACTCTGCTGTTTATTTCTGTGCTAGGAGAGAAACCACTGTCAAGC | −1 |
| 901. | 5241 | H1 | GYAFSSYW | G26-W33 |
| 902. | 5241 | H1 | GGCTATGCATTCTCTAGTTACTGG | −1 |
| 903. | 5241 | H3 | ARRETTTVGRYYYAMDY | A97-Y113 |

TABLE YY-continued

| SEQ ID No. | Clone | Description | sequence | |
|---|---|---|---|---|
| 904. | 5241 | H3 | GCTCGGAGAGAAACCACAACTGTGGGCCGCTACTATTACGCCATGACTAT | -1 |
| 905. | 5241 | H3 | IWPGDGDT | I51-T58 |
| 906. | 5241 | H2 | ATTTGGCCAGGCGACGGGGATACA | -1 |
| 907. | 5241 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A125-V222 |
| 908. | 5241 | CH1 | GCTAGCACTAAAGGGCCTTCCGTGTTTCCACTGGCACCCCTCCTCTAAGAGCACATCCGGAGGAACTGCAGCTCTGGGATGTCTGGTGAAGGATTACTTCCCAGAGCCGTCACAGTGTCATGGAACAGCGGCGACTAGCGGGGTCCACACCTTTCCTGCTGTCCAGAGTTCCAGCGTGTATTCCCTGAGCTCCGTGGTCACCGTGCCATCTAGTTCACTGGGGACCCAGACATACTGCAACGTGAATCACAAACCATCCAATACAAAGGTCGACAAGAAAGTG | -1 |
| 909. | 5241 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A238-K347 |
| 910. | 5241 | CH2 | GCTCCAGAGCTGCTGGGAGGACCAAGCGTGTTCCTGTTTCCACCCAAGCCAAAGGACACACTGATGATTAGCCGAACCCCAGAAGTGACATGCGTGGTCGTGGACGTGAGCCACGAGGACCCCGAAGTCAAATTCAACTGGTACGTGGACGGTGTCGAGGTGCATAATGCCAAAACAAAGCCCCGGGAGGAGCAGTACAATAGCACCTACAGAGTCGTGAGCGTGCTGACCGTCCTGCACCAGGACTGGCTGAATGGCAAGGAGTACAAGTGCAAGGTGTCCAACAAAGCCCTGCCTGCCCCCATCGAGAAAACCATATCAAAGGCCAAG | -1 |
| 911. | 5241 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G348-G453 |
| 912. | 5241 | CH3 | GGCCAGCCTCGAGAACCACAGGTCTATGTGCCCCCAAGTCGGGACGAGCTGACCAAGAACCAGGTCAGCCTGACCTGTCTGGTGAAGGGCTTTTATCCCTCCGATATTGCAGTGGAGTGGGAATCTAATGGACAGCCTGAGAATAACTACAAGACCACTGTGCCGCTACTATTAGATAGCGACGGCAGCTTCTTCCTGTACTCTCGCCTGACAGTCGATAAATCCAGGTGGCAGCAGGGAAACGTCTTCAGCTGCAGTGTTATGCACGAGGCACTGCATAATCATTACACCCAGAAGTCACTGAGCCTGTCCCCGGGC | -1 |
| 913. | 5242 | Full | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | -1 |
| 914. | 5242 | Full | CAGGTCCAGCTGCAGCAGTCTGGAGCCGAACTGGTCAGACCCGGGTCATCAGTCAAAATCAGCTGCAAGGCTTCAGGATACGCCTTTTCTTCTTACTGGATGAACTGGGTCAAGCAGAGACCAGGCCAGGGATGATGGGAGTGGATTGGACAGATTTGGCCAGGTGATGGTGATACTAACTATAATGGAAAGTTCAAAGGAAAGGCCACACTGACTGCCGACGAGTCCAAGCTCCACTGCTTATATGCAGCCTCAGCAGCCTGGAAGACAGACACGGGATCTAGGGGGCTACTATTACGCAATGGACTATTGGGGCCAGGGAACAACTGTGACAGTCAGCAGTGCTAGTACAAAAGGCCCATCAGTCTTCCCACTAGCCCCCTCTTCCAAAAGTACATCTGGAGGAACAGCTGCCTCAGGAACCAAGGCAACATGGTGTGCCTGGTCAAGGACTACTTCCCTGAGCCTGTGACAGTCAGCTGGAACTCAGGAGCACTGACCAGCGGTGTGCACACATTTCCAGCTGTCCTACAGAGGAGGGGAGAGCGACGGGAAGCACCCTGAAAGAGAAAACCACGAAGACTGATAATGCCAAAAGGAAGGTGCATCTGAACTGCAGGCTACAAGATTCACCAAGAACCTCAATGAAAAAAGCATCTGCAAACCCTCCTGTGAGCACACACCAACTGAAGTCAAATTCAACTGGTACGTGGATGGGGTCGAGGTGCATAATGCCAAAACCAAGCCGCGGGAGGAGCAGTATAATTCCACATACAGAGTGGTCAGCGTGCTGACAGTCCTGCACCAGGACTGGCTGAATGGCAAGGAATACAAATGTAAAGTCTCCAACAAAGCCCTTCCAGCCCCCATCGAGAAAACCATCTCAAAGGCCAAGGGACAAGCTGATAATATGGAGACAATGTATCGCCAAAAGCTTCACCTCTGGTGAAGGAAAGCACAATTGCAAGACTGTGCTGTCTGACAGTGTGACAGTGCACCAGGACTTACTAGGTGGACAAGTCTAGGTGGCAGCAGGGCAACGTCTTTTCATGTGTGATGCATGAGGCCCTGCACAACCACTATACCCAGAAGAGCCTCTCCCTGTCTCCGGGCT | -1 |
| 915. | 5242 | VH | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS | Q1-S124 |

TABLE YY-continued

| SEQ ID No. | Clone | Description | Sequence | | |
|---|---|---|---|---|---|
| 916. | 5242 | VH | CAGGTTCAGCTGCAGCAGTCCGGAGCCGAACTGGTCAGACCGGCAGCTGGCAGCTGGCAGCTCCGGCTATGCTTTCTCTAGTTACTGATGAACTGGGGTGAAGCAGAGGCCTGGGCAGGCTCCACTGCTTATGCAGTCGATTGGCCCAGCGACATTTGCCCAGGGATACAACTATAATGGAAGGAAGCAACACTGACTGCCGACGAGTCAAGCTCCACTGGGACAGGGCACCAGTCACAGTGTCAAGCCGCAATTGACTATTGGGGACAGGGCACCAGTCACAGTGTCAAGC | | -1 |
| 917. | 5242 | H1 | GYAFSSYW | G26-W33 | -1 |
| 918. | 5242 | H1 | GGCTATGCTTTCTCTAGTTACTGG | | -1 |
| 919. | 5242 | H3 | ARRETTTVGRYYYAMDY | A97-Y113 | -1 |
| 920. | 5242 | H3 | GCCCGGAGAGAAACCACAACTGTGGGCCGCTACTATTACGCAATGACTAT | | -1 |
| 921. | 5242 | H2 | IWPGDGDT | I51-T58 | -1 |
| 922. | 5242 | H2 | ATTTGGCCAGGCGACGGGGATACA | | -1 |
| 923. | 5242 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A125-V222 | -1 |
| 924. | 5242 | CH1 | GCCTCTACTAAAGGGCCTAGTGTGTTTCCACTGGCTCCCTCCTCTAAGAGCACATCCGGAGGAACTGCAGCTCTGGGATGTCTGGTGAAGGATTACTTCCCAGAGCCCGTCACAGTTCTCTGGAACTCTGGCGCTGTACAGCTCTGCAGATTCAGGCGCTGTATAGCCTGAGCTCCGTGGTCACCGTGCCATCAGTTCACTGGGACCCAGACATCTGCAACGTGAATCACAAGCCATCACAAAGGTGCACAGAAGTG | | -1 |
| 925. | 5242 | CH2 | APEAAGGPSVFLFPPKPKDTLMISRTPEVTCVVVSVSHEDPEVKFNWYVDGVEVHNAKTPREEQYNSTYRVVSVLTVLHQDWLNGKEYKCKVSNKALPAPIEKTISKAK | | -1 |
| 926. | 5242 | CH2 | GCACCAGAGGCAGCAGGAGACCCGAGTCGTTTCCTGTTTCCACCCAAAACTTAAGGACACACTGATGATTTCCGAACCTGAGGTGCATAATGCCAAGACCAAGGAGGAGCAGTATATTAATTCAACTTACCGCGTCGTGAGCGTCCTGACCGTGCTGCACCAGGATTGGCTGAACGGAAAGGAGTACAAATGCAAGGTCTCCAACGAAATGCCAACCTATCGAGAAGACAATTCTAAAGCTAAG | A238-K347 | -1 |
| 927. | 5242 | CH3 | GQPREPQVYVTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G348-G453 | -1 |
| 928. | 5242 | CH3 | GGCCAGCCTCGAGAACCACAGGTCTATGTGTACCCTCCATCCCGGGACGAGCTGACCAAAAACCAGGTCTCTCTGACATGTCTGGTGAAGGGGTTTTATCCCAGTGATATTGCCGTGGAGTGGGAAAGCAATGGACAGCCTGAAAACAATTACAAGACTACACCCCCTGTCCTGGACAGTGATGGATCAATTCGCACTGGTCTCCAAACTGACTGTGGACAAGTCTAGGTGGCAGCAGGGCAACGTCTTTTCATGTGCGTGAGTCATGAGGCCCTGCACAATCATTACACCCAGAAGTCCCTGTCTCTGAGTCCGGGC | | -1 |
| 929. | 5243 | Full | DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGCGTKLEIKGGGGSGGGGSGGGGSQVQLQSGAELVRPGSSVKISCKASGYAFSSYWMNWVKQRPGQCLEWIGQIWPGDTNYNGKFKGKATLTADESSSTAYMQLSLASEDSAVYFCARRETTTVGRYYYAMDYWGQGTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | | -1 |
| 930. | 5243 | Full | GATATTCAGCTGACTCAGAGTCCTGCTTCACTGGCAGTCTCTCTAGATCAGAGAGCCACCATCTCCTGCAAAGCTAGTCAGTCAGTTGACTATGATGGAGACTCCTATCTGAACTGGTACCAGCAGATCCCAGGCCAGCCCCCTAAGCTGCTGATCTACGACGCCTCAAATCTGGTGAGCGGCATCCCACCGATTCAGCGGCTCTGGGACTGATTTTACCCTGAACATTCACCCAGTCGAGAAGGTGGACGCCGCTACATACCATTGCCAGCAGTCTACCGAGGACCCCTGGACATTCGGATGTGGCACTAAACTGGAAAT | | -1 |

TABLE YY-continued

| SEQ ID No. | Clone | Description | Sequence | |
|---|---|---|---|---|
| 931. | 5243 | VL | CAAGGAGGAGAGAGGCAGTGCGGAGAGGGTCAGGAGGAGGAGGTCGAGCTGCAGCTGCAGCTGCAGAGAGCTGGAGGCAGAGAGTGGTCAGATCAGGAGAAGCTCCGTGAAATTTCCTGCAAGGCATCTGGCTTCTGTTACTGTAGTTACTGGATGAATTGGGTCGAGACAGAGGCCTGGTCAAGGGCTTGAATGGATTGGAGACACAAACTATATGCCACGACAGAAACCACAACTGTGGGCAGTCTACTACGGACTGTGTACTTTTGCCGATAAGAACCACACAGCCTCACTGTACCTGCAGATGGACCACAGTGACAATGCACGCACAGCCGAACCCAAATCTCTGATAAGACCACAGTCCCCTCTGTCCAGTCCCATGTCGTGTGAGCTGCTGAGCGACACTGCCCCATGTCGATGCACGATGTTCCACCTAAGGACACTCTGATGATCTCTCGGACACCCGAAGTCACTTGTGTGTGTGAGGACAGTATAACTCCACTTACCGCTGTCTCTGCAAGAGAGAGTCAAATCCAAAGTGTGATGCAACAAGCCTAGGGAGAACAGTATATACTCCACTTACCGCGTCTCTGCCAGAAGCCTAGTGGAGGAAGGTCAAAAGTGAGCAACAAGGCCCTGCCAGCTCCATGCAGACCATTTCCAAAGAACCATTTATCCTTCAATATGTCCGTGAAGGGTTTTATCCTCAATGTCCGTGGAATTTGCCGTGAAGGGTTCTGGAAGGGTTTTATCCTCGATAAGCCGATAAGGCTTCGCAGAATTCGCATTTCGCAGACTCGTCCCTGACGGCAGTTTCGCATCGCGTCAGTAAGTCACGGTCGATAAGCCGGAGGATTCACCCTCTTGTTCAGTGATGCACGAGCCCTGCACAATCATTCTGACGGCAGTTTCGCACTGCCCTGTCCCGGC | D1-K111 |
| 932. | 5243 | VL | GATATTCAGCTGACTCAGAGTCCTGCTTCAGGCCTCTGTGGCAGTCTGGAGCTGAGCCTGGACACAGGAGCAACCATCTCCTGCAAAGCTAGTCAGTCAGTGGACTATGATGGAGACTCCTATCTGAACTGGTACCAGCAGATCCCAGGCCAGCCCCCTAAGCTGCTGATCTACGATGCATCCAATCTGGTGAGCGGCATCCCACGAGGATTCAGCGGCAGCGGGTCTGGGACTGATTTTACCCTGAACATTCACCCAGTCGAGAAGGTGGACGCCGCTACATACCATTGCCAGCAGTCTACCGAGGACCCTTGGACATTCGGATGTGGCACTAAACTGGAAATCAAG | -1 |
| 933. | 5243 | L1 | QSVDYDGDSY | Q27-Y36 |
| 934. | 5243 | L1 | CAGTCAGTGGACTATGATGGAGACTCCTAT | -1 |
| 935. | 5243 | L3 | QQSTEDPWT | Q93-T101 |
| 936. | 5243 | L3 | CAGCAGTCTACCGAGGACCCCTGGACA | -1 |
| 937. | 5243 | L2 | DAS | D54-S56 |
| 938. | 5243 | L2 | GACGCCTCA | -1 |
| 939. | 5243 | VH | QVQLQQSGAELVRPGSSVKISCKASGYAFSSYWMNWVKQRPGQCLEWIGQIWPGDGDTNYNGKFKGKATLTADESSSTAYMQLSSLASEDSAVYFCARRETTTVGRYYYAMDYWGQGTTVTVSS | Q127-S250 |
| 940. | 5243 | VH | CAGGTGCAGCTGCAGCAGAGCGGAGCGGAGCTGGTCAGACCAGGAGCATCTGCTATGCCCTTTTCTGCAAGGCAAGCGGCTATGCCTTCTCAAGCAGTGTCTGGAATGAATGGGTGAAGCAGAGACCAGGACAGTGTTGGAATGCAGTGCAATTCCGCCCGGGGATGGCCAGATTCGCCCGGCAGCCAGATTCTGGCCAGGATCTGGCCAGGCAATCAAAACTATAATGGAAAGTTCAAAGGCAAGGCTACACTGACTGCAGACGAGTCAAGCTCACTGCTTATATGCAGCTGTCAAGCCTGGCCAGCGAGGACTCCGCTGTGTACTTTTGTGCCCGGAGAGAAACCACAACTGTGGGCAGGTACTATTACGCAATGGACTATGGGGGGCAAGGCACACCGTCACCGTCTCCTCAGC | -1 |
| 941. | 5243 | H1 | GYAFSSYW | G152-W159 |
| 942. | 5243 | H1 | GGCTATGCCTTTTCTAGTTACTGG | -1 |
| 943. | 5243 | H3 | ARRETTTVGRYYYAMDY | A223-Y239 |
| 944. | 5243 | H3 | GCACGCGAGAGAAACCACAACTGTGGGCAGGTACTATTACGCAATGGACTAC | -1 |

TABLE YY-continued

| SEQ ID No. | Clone | Description | Sequence | |
|---|---|---|---|---|
| 945. | 5243 | H2 | IWPGDGDT | I177-T184 |
| 946. | 5243 | H2 | ATTTGGCCCGGGGATGGAGACACA | -1 |
| 947. | 5243 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A268-K377 |
| 948. | 5243 | CH2 | GCACCTGAGCTGCTGGGAGGACCAAGCTGTTCCTGTTTCCACCTAAACCTAAGGACACTCTGATGATCTCTCGGACACCCGAAGTCACTTGTGTGTGTGGATGTGAGCCACGAGGACCCTGAAGTCAATTCAACTGGTACGTGGATGGTGTCGAGGTGCATAATGCCAAGACAAAGCCTAGGGAGGAACAGTATAACTCCACCTACCGCGTGTGTCTGTCCGTGCTGACCGTGCTGCATCAGGATTGGCTGAACGGCAAAGAGTACAAGTGCAAGGTCTCCAACAAGGCCCTGCCAGCCCCCATCGAGAAGACCATTTCCAAAGCTA AG | -1 |
| 949. | 5243 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G378-G483 |
| 950. | 5243 | CH3 | GGCCAGCCTCGAGAGAACCACAGGTCTATGTGTACCCACCCCAGCCTGAGGAAGAAATGACCAAGAACCAAGTGTCTCTGACATGTCTCGGTGAAGGGCTTTTATCCTTCTGATATTGCCGTGGAATGGGAAAGTAATGGACAGCCAGAGAACAATTACAAGACTACACCCCCTGTGCTGGATTCTGACGGCTCAGTTTCGAGTGTCAGTAAACTGACCGTGGATAAGTCACGGTGGCAGCAGGGGAACGTCTTTAGTTGTTCAGTGATGCACGAGGCACTGCACAATCACTACACACAGAAGAGCCTGTCCCTGTCTCCGGGC | -1 |
| 951. | 2174 | Full | QVQLQQSGAELARPGASVKMSCKASGYTFTRYTMHWVKQRPGQGLEWIGYINPSRGYTNNQKFKDKATLTTDKSSSTAYMQLSSLTSEDSAVYYCARYDDHYSLDYWGQGTTLTVSSTGGGGSGGGGSGGGGSDIQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVSHEDPEVKFNWYVDGVEHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK | -1 |
| 952. | 2174 | Full | CAGGTCCAGCTGCAGCAGAGCGGAGCTGAGCTGGCACGACCAGGAGCTGGCGAGCTGGAATGGATCGGGTACATTAACCCTAGCAGAGGCTACACTAATAACCAGAAGTTCAAGGACAAGGCCACACTGACTACAGACAAGAGCTCCTCTACAGCCTACATGCAGCTGAGCAGCCTGACCTCTGAGGACTCTGCCGTGTACTATTGTGCTCGCTATGATGACCATTATAGCCTGGACTACTGGGGCCAGGGCACACTGACCGTGTCTAGCACAGGCGGAGGATCTGGCGGAGGTGGAAGCGGAGGAGGCGGATCCGACATCCAGATTGTGCTGACCCAGAGCCCAGCCATCATGTCCGCCTCTCCGGCGAAATCGTCACCATGACATGTTCAGCCTCCTCTTCCGTCTCTTATATGAATTGGTATCAGCAGAAGAGCGGGACCTCTCCAAAGCGCTGGATTTACGACACATCTAAGCTGGCCTCAGGAGTGCCCGCCCACTTCAGGGGCTCTGGATCTGGAACTAGCTATAGCCTCACAATCAGCGGCATGGAGGCAGAAGATGCCGCCACATATTATTGCCAGCAATGGAGCTCCAATCCATTTACCTTTGGATCTGGCACCAAGCTGGAGATCAATAGAGCTGCAGAGCCCAAGTCCAGCGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGATGAGCTGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGCAAG | -1 |
| 953. | 2174 | VH | QVQLQQSGAELARPGASVKMSCKASGYTFTRYTMHWVKQRPGQGLEWIGYINPSRGYTNNQKFKDKATLTTDKSSSTAYMQLSSLTSEDSAVYYCARYDDHYSLDYWGQGTTLTVSS | Q1-S119 |
| 954. | 2174 | VH | CAGGTCCAGCTGCAGCAGAGCGGAGCTGAGCTGGCACGACCAGGAGCTGGCGAGCTGGAATGGATCGGGTACATTAACCCTAGCAGAGGCTACACTAATAACCAGAAGTTCAAGGACAAGGCCACACTGACTACAGACAAGAGCTCCTCTACAGCCTACATGCAGCTGAGCAGCCTGACCTCTGAGGACTCTGCCGTGTACTATTGTGCTCGCTATGATGACCATTATAGCCTGGACTACTGGGGCCAGGGAACCCTGACCGTGAGCTCC | -1 |

| SEQ ID No. | Clone | Description | Sequence | |
|---|---|---|---|---|
| 955. | 2174 | H1 | GYTFTRYT | G26-T33 |
| 956. | 2174 | H1 | GGCTACACCTTCACACGGTATACT | -1 |
| 957. | 2174 | H3 | ARYYDDHYSLDY | A97-Y108 |
| 958. | 2174 | H3 | GCACGGTACTATGACGATCATTACTCCCTGGATTAT | -1 |
| 959. | 2174 | H2 | INPSRGYT | I51-T58 |
| 960. | 2174 | H2 | ATTAACCCTAGCCGAGGATACACC | -1 |
| 961. | 2174 | VL | QIVLTQSPAIMSASPGEKVTMTCSASSSVSYMNWYQQKSGTSPKRWIYDTSKLASGVPAHPRGSGSGTSYSLTISGMEAEDAATYYCQQWSSNPFTFGSGTKLEIN | Q140-N245 |
| 962. | 2174 | VL | CAGATTGTGCTGACACAGTCTCCAGCAATCATGTCCGCTTCTCCCGGCGAGAAAGTCACTATGACCTGCTCCGCTTCAAGCTCCGTGTCTTACATGAATTGGTATCAGCAGAAATCAGGAACCAGCCCCAAGAGATGGATCTACGACACATCCAAAGCTCTGGCCTCTGGGGTCCCAGCTCATCCTCGAGGATCAGGAGTCAGTGGGACTAGCTATTCCCTGACCATTAGCGGCATGGAGGCCGAAGATGCCGCTACCTACTATTGTCAGCAGTGGTCTAGTAACCCATTCACATTTGGCAGCGGGACTAAGCTGGAGATCAAT | -1 |
| 963. | 2174 | L1 | SSVSY | S166-Y170 |
| 964. | 2174 | L1 | AGCTCCGTGTCTTAC | -1 |
| 965. | 2174 | L3 | QQWSSNPFT | Q227-T235 |
| 966. | 2174 | L3 | CAGCAGTGGTCTAGTAACCCATTCACA | -1 |
| 967. | 2174 | L2 | DTS | D188-S190 |
| 968. | 2174 | L2 | GACACATCC | -1 |
| 969. | 2174 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A264-K373 |
| 970. | 2174 | CH2 | GCACCAGAACTGCTGGGAGGACCTTCCGTGTTCCTGTTTCCACCCAAACCAAAGGATACACTGATGATTAGCCGACACCCCTGAGTCACATGCGTCGTCGTCGACGTGAGCCACGAGGACCCCGAAGTCAAGTTCAACTGGTACGTGGACGGCGTCGAAGTGCATAATGCCAAAACCAAGCCTAGGGAGGAACAGTACAACAGTACATATAGAGTCGTGTCAGTGCTGACCGTCCTGCACCAGGATTGGCTGAACGGCAAGGAGTACAAATGCAAAGTGTCCAATGCCAAGGCCCTGCCTGCTCCAATCGAGAAGACCATTTCTAAAGCAAAG | -1 |
| 971. | 2174 | CH3 | GQPREPQVYVPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G374-G479 |
| 972. | 2174 | CH3 | GGGCAGCCCCGAGAACCTACGTGTATCCTCCAAGCGTCTACGTAGAACCAGACTCCGAGACGCTGACTAAGAACCAGGTCTCTCTGACCTGTCTGGTGAAGGGCTTTTACCCATCTGATATTGCTGTCGAGTGGAAGTGGAATGGGCAGCCCGAGACAATTATAAGACAATGTCGAGACTGGACTCCGATGGGTCTTTCGCCCTGGTCAGCAAGCTGACAGTGGATAAGTCCAGATGGCAGCAGGGGAAACGTCTTTTCTGTGTGTGATGCATGAAGCTGTGCACAATCATTACACTCAGAAATCACTCTGCCCCGGC | -1 |

TABLE YY-continued

| SEQ ID No. | Clone | Description | sequence | |
|---|---|---|---|---|
| 973. | 2175 | Full | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGGGTKLEIKGGGG SGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRE TTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYVLPPSRDELTKNQVSLTCLVKGFYPSDIAVEWESNGQPENNYLTWPPVLDSDGSFFLYSKLTVDKSRW QQGNVFSCSVMHEALHNHYTQKSLSLSPGK | -1 |
| 974. | 2175 | Full | GACATTCAGCTGACCCAGAGTCCTGCTTCACTGGCAGTCCTGGGACAGCGAGCCAACAATCTCTGCCAAAGCTAGTCAGTCAGTGGACTATGATGGCGACTCCTATCT GAACTGGTACCAGCAGCATCCCAGGGCAGCCCCCTAAGCTGCTGATCTATGACGCGTCCAATCTGGTGAGCGGCATCCCACCACGGTTCAGCGGCAGCGGCTCTGAACC GATTTTACACTGAACATTCACCCAGTCGAGAAGGTGACGCCCTACCAGTGCCAGCAGAGCACCGAGGACCCCTGGACTTTCGGCGGCGAGGAACCAAACTGGAAA TCAAGGAGGAGGAGCAGTCAGGAGCAGGTCAGCTGCAGCAGAGCGGGAGAGCTGGTCCGCGCGGCTCCAGCGTGAAGATCAGCTGTAAGGCTAGTGGCTACGCGTTTTAGC AAATTCCTGTAAGGCATCTGGCTATGCCTTTTCAGTTCTACTGGATGAATTGGGTGAAGCAGAGACCAGGACAGGGCCTGGAATGGGATCGGGCAGATTTGGCCCGGGA TGGAGACACAAACTATATAATGGCAAGTTCAAAGGGAAGGCCACACTGACTGCAGACGAGTCAAGCTCCACTGCATATATGCAGCTGTCTAGTCTGGCAAGCGAGGATTCC GCTGTCTACTTTTGCCACGGACAGCACAGTATACCTCTGATAATACCGGTCTGTCTGTGAAGCTAAGGCTAAGGCAGGTTCTCAAAGCTAAGGCTAAGCTGTTCCTGTTTCCACATTATCTGACTTGCCTCCAGTGCTGA CTCGGACTCCCTGATAATACCGGTCGTGTGACTCGGATGTAAAATTCAACTGGTACGTGGATGGCGTCGAGGTGCATAATGCCAAAACAAA GCCTAGGGAGGAACAGTATAACTCCAAGAACCATTTCAAAGCTAAGGCCTGTGTCTGAGAACCAGCCAGCGGGCGAGCAGCTGACAAAAACCAG GTCTCCCTGCTGTGTGTCCAGCTGGTGAAGGGATTCTACCCTTCTGATATCGCAGTGGAGTGGGAAAGCAATGCCCAGCAGAAACAATTATCTGACTTGGCCTCCAGTGCTGA TTCTGACGGAGTTCTTTCTGTACAGTGATAAACTGACAGTGGATAAGTCACGCTGGCAGCAGGGGAAAGTCTTTAGTTGTTCAGTGATGCACGAGGCCCTGCACAATCATT ACACCCAGAAGAGCCTGTCCCTGTCTCCCGGCAAG | -1 |
| 975. | 2175 | VL | DIQLTQSPASLAVSLGQRATISCKASQSVDYDGDSYLNWYQQIPGQPPKLLIYDASNLVSGIPPRSGSGSGTDFTLNIHPVEKVDAATYHCQQSTEDPWTFGGGTKLEIK | D1-K111 |
| 976. | 2175 | VL | GACATTCAGCTGACCCAGAGTCCTGCTTCACTGGCAGTCCTGGGACAGCGAGCCAACAATCTCTGCAAAGCTAGTCAGTCAGTGGACTATGATGGCGACTCCTATCT GAACTGGTACCAGCAGCATCCCAGGGCAGCCCCCTAAGCTGCTGATCTATGACGCGTCCAATCTGGTGAGCGGCATCCCACCACGGTTCAGCGGCAGCGGCTCTGAACC GATTTTACACTGAACATTCACCCAGTCGAGAAGGTGGACGCCGCTACCCAGTGCCAGCAGAGCACCGAGGACCCCTGGACTTTCGGCGGCGAGGAACCAAACTGGAAA TCAAG | -1 |
| 977. | 2175 | L1 | QSVDYDGDSY | Q27-Y36 |
| 978. | 2175 | L1 | CAGTCAGTGGACTATGATGGCGACTCCTAT | -1 |
| 979. | 2175 | L3 | QQSTEDPWT | Q93-T101 |
| 980. | 2175 | L3 | CAGCAGTCTACAGAGGACCCCTGGACT | -1 |
| 981. | 2175 | L2 | DAS | D54-S56 |
| 982. | 2175 | L2 | GACGCCTCA | -1 |
| 983. | 2175 | VH | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTVGRYYYAM DYWGQGTTVTVSS | Q127-S250 |
| 984. | 2175 | VH | CAGGTGCAGCTGCAGCAGAGCGGAGCAGAGCTGGTCAGACAGGAAGCTCCGTGAAGAAGCTCCGTGAAGATTTCCTGTAAGGCATCTGGCTATGCCTTTCTAGTTACTGATGAATTGGG TGAAGCAGAGACCAGGACAGGGCCTGGAATGGATCGGCAGATTTGGCCCGGGGATGGAGACACAAACTATAATGGAAAGTTCAAAGGCAAGGCTAACACTGACTCTGACCGCA GACGAGTCAAGCTCCACTGCATATATGCAGCTGTCTAGTCTGGCAAGCGAGGATTCCGCTGTCTACTTTTGCGCACGGAGAAACCACAGTTGGGGCAGGTACTATTA CGGCCATGGACTACTGGGGCCAGGGGACCACAGTCACCGTGTCAAGC | -1 |

TABLE YY-continued

| SEQ ID No. | Clone | Description | Sequence | |
|---|---|---|---|---|
| 985. | 2175 | H1 | GYAFSSYW | G152-W159 |
| 986. | 2175 | H1 | GGCTATGCCTTTTCTAGTTACTGG | -1 |
| 987. | 2175 | H3 | ARRETTTVGRYYYAMDY | A223-Y239 |
| 988. | 2175 | H3 | GCACGGAGAGAAACCAACTGTGGGCAGTACTATTACGGCCATGGACTAC | -1 |
| 989. | 2175 | H2 | IWPGDGDT | I177-T184 |
| 990. | 2175 | H2 | ATTTGGCCCGGGGATGGAGACACA | -1 |
| 991. | 2175 | CH2 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK | A268-K377 |
| 992. | 2175 | CH2 | GCTCCTGAGCTGCTGGGAGGACCAAGCGTGTTCCTGTTCCCACCTAAACCTAAGGACACTCTGATGATCTCTCGAACTCCCGAAGTCACCTGTGTCGTGGATGTGAGCCACGAGGACCCTGAAGTCAAATTCAACTGGTACGTGGATGGCGTCGAGGTGCATAATGCCAAAACAAAGCCTAGGGAGGAACAGTATAACTCCACATACCGCGTCGTGTCTGTCCTGACTGTGCTGCATCAGGACTGGCTGAACGGAAAGGAGTACAAATGCAAGGTGAGCAACAAAGCCCTGCCAGCTCCCATCGAGAAGACCATTTCCAAAGCTAAG | -1 |
| 993. | 2175 | CH3 | GQPREPQVYVLPPSRDELTKNQVSLLCLVKGFYPSDIAVEWESNGQPENNYLTWPPVLDSGSFFLYSKLTVDKSRWQQGNVFSCSVMHEALHNHYTQKSLSLSPG | G378-G483 |
| 994. | 2175 | CH3 | GGCCAGCCTCGAGAACCACAGGTCTATGTGCTGCCACCAAGCCGGGACGAGCTGACAAAAAACCAGTCTCCCTGCTGTGTCGTTGAAGGGATTCTACCCTTCTGATATTGCAGTGGAGTGGGAAAGTAATGGCCAGCCAGAAAACAATTATCTGACTTGGCCTCCAGTGCTGGACAGCGGATCTTTCTTCCTGTACAGTAAACTGACCGTGGATAAGTCACGGTGGCAGCAGGGAAACGTCTTTAGTTGTTCAGTGATGCACGAGGCCCTGCACAATCATTACACCCAGAAAAGCCTGTCCCTGTCTCCCGGC | -1 |
| 995. | 11176 | Full | STAIALLLAVLLQGVCSQVQLVQSGAEVKKPGASVKISCKASGYAFSSYWMNWVRQAPGQCLEWIGQIWPGDGDTNYAQKFQGRATLTADESTSTAYMELSSLRSEDTAVYYCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | -1 |
| 996. | 11176 | Full | ATGGGCTCCACCGCTATCCTGCTGCTGGCCCTGCTGCTGCAGGAGGTGTGCTCCCAGGTGCAACTGGTTCAGAGCGGCGCTGAGGTGAAGAAGCCTGGCGCTTCCGTGAAGATCTCCTGCAAGGCTAGCGGCTACGCCTTCTCCTCCTACTGGATGAACTGGGTCAGGCAGGCCCCTGGCCAGTGCCTGGAGTGGATTGGCCAGATCTGGCCCGGAGACAGAGACCAACTACGCCCAGAAGTTCCAAGGACGGGCCACCCTGACCGCCGATGAGTCCACCTCCACCGCCTACATGGAGCTGTCCTCCCTGAGGTCCGAGGACACCGCTGTACTACTGTGTCCAGGAGGAGAGAACCACCTGGAAGGGAGGACAACACCGTGACCGTCTCCTCGGCCAGTACTTCCCGAGCCCGTGACCGTGCCAAGGGCCCTTCCGTGTTCCCTCTGGCTCCCAGCTCCAAGTCACCTCCGGCGGAACTGGAGCGGCCACCTACGGCCACAGCGAGTCTTCCCGGCCGTGACCCTGGTCGTCCCCTGTCTCCTGACCAGTCCTCCGGGCCCTGAAGGAGAGGAGCACTCCCAGCACCAAGGCCACCTGTGCCGACCTGCTGGCCCCAAGTCACCCCCAGACCACAAGCCCAGCAAGCCCAGACCACAAGCCCAGCAAGCCCAGCAAGCCCAGGCTCCGAGACCACACGCCTAAGCTGAACGTCAAGACTGCGCCCGTGGCCAGCCACTGGAGGAGGAGCACCTGCCTGCCGTCCATCGAGAGAGACCATCTCCAAGG | -1 |

TABLE YY-continued

| SEQ ID NO. | Clone | Description | sequence | |
|---|---|---|---|---|
| 997. | 11176 | VH | CCAAGGGCCAGCCCAGGAACCTCAGTGTACGTGTACCCCCCCTCCAGGAGGACGAGCTGACCAAGAACCAGGTGTCCCTGACCTGCCTGGTGAAGGGCTTCTACCCCTC CGACATCGCTGTGGAGTGGGAGTCCAACGGCCAGCCCGAGAACAACTACAAGACCACACCCCGTGCTGGACAGCGACGGATCCTTCGCCCTGGTGTCCAAGCTGACC GTGGACAAGTCCAGGTGGCAGCAGGGCAACGTGTTCTCCTGCTCCGTGATGCACGAGGCCCTGCACAACCACTACACCCAGAAGTCCCTGTCCCTGTCCCCC | Q18-S141 |
| 998. | 11176 | VH | QVQLVQSGAEVKKPGASVKISCKASGYAFSSYWMNWVRQAPGQCLEWIGQIWPGDGTNYAQKFQGRATLTADESTSTAYMELSSLRSEDTAVYYCARRETTTVGRYYYAM DYWGQGTTVTVSS | -1 |
| | | | CAGGTGCAACTGGTCCAGAGCGGCGCTGAGGTGAAGAAGCCTGGCGCCTCCGTGAAGATCTCCTGCAAGGCCAGCGGCTACGCCTTCTCCTCCTACTGGATGAACTGGG TGAGGCAGGCTCCTGGCCAGTGCCTGGAATGGATTGGCCAGATCTGGCCAGATCTGGCCTCCCTGAAGTTCCAAGGACGGGCCACCCTGACCGCCG ATGAGTCCACCTCCACCGCCTACATGGAGCTGTCTCCTGAGGTGTACTACTGTGCCAGAGGAGACAACCACCGTGGGCCCGTACTACTA CGCCATGGACTACTGGGGCCAGGGCACCACAGTCACCGTCTCC | |
| 999. | 11176 | H1 | GYAFSSYW | G43-W50 |
| 1000. | 11176 | H1 | GGCTACGCCTTCTCCTCCTACTGG | -1 |
| 1001. | 11176 | H3 | ARRETTTVGRYYYAMDY | A114-Y130 |
| 1002. | 11176 | H3 | GCCAGAGGAGAGACAACCACCGTGGGCCGGTACTACTACGCCATGGACTAC | -1 |
| 1003. | 11176 | H2 | IWPGDGDT | I68-T75 |
| 1004. | 11176 | H2 | ATCTGGCCCGGAGACGGCGACACC | -1 |
| 1005. | 11176 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A142-V239 |
| 1006. | 11176 | CH1 | GCCAGCACCAAGGGCCCTTCCGTGTTCCCCCTGGCTCCCTCCAGTCCACCAGCGGAGGCACAGCCGCTCTGGGCTGCCTGGTGAAGGACTACTTCCCCGAGCCCGT GACCGTGAGCTGGAACTCTGGAGCCCTGACCTCCGGCGTGCATACCTTCCCCGCCGTGCTGCAGTCCTCCGGACTCTACTCCCTGTCCTCCGTGGTGACAGTGCCCTCTC CTCCCTGGGCACCCAGACCTACATCTGCAACGTGAACCACAAGCCCTCCAACACCAAGGTTGATAAGAAGGTG | -1 |
| 1007. | 11176 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A255-K364 |
| 1008. | 11176 | CH2 | GCTCCTGAGGCTGCCGGAGGCCCCTCCGTGTTCCTGTTCCCCCCAAAGCCCAAGGACACCCTGATGATCAGCAGGACACCCCCGAGGTGACCTGCGTGGTGGTGTCCGTGA GCCACGAGGACCCCGAGGTGAAGTTCAACTGGTACGTGGACGGCGTGGAGGTGCACAATGCCAAGACCAAGCCCAGGGAGGAGCAGTACAACAGCACCTACAGGGTG GTGTCCGTGCTGACCGTGCTGCACCAGGACTGGCTGAACGGCAAGGAGTACAAGTGCAAGGTGTCCAACAAGGCCCTGCCCGCTCCCATCGAGAAGACCATCTCCAAGG CCAAG | -1 |
| 1009. | 11176 | CH3 | GQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G365-G470 |
| 1010. | 11176 | CH3 | GGCCAGCCCAGGGAACCTCAGGTGTACGTGTACCCCCCCTCCAGGGACGAGCTGACCAAGAACCAGGTGTCCCTGACCTGCCTGGTGAAGGGCTTCTACCCCTCCGACA TCGCTGTGGAGTGGGAGTCCAACGGCCAGCCCGAGAACAACTACAAGACCACACCCCCGTGCTGGACAGCGACGGATCCTTCGCCCTGGTGTCCAAGCTGACCGTGGA CAAGTCCAGGTGGCAGCAGGGCAACGTGTTCTCCTGCTCCGTGATGCACGAGGCCCTGCACAACCACTACACCCAGAAGTCCCTGTCCCTGTCCCCCGGC | -1 |
| 1011. | 11177 | Full | FGLSWLFLVAILKGVQCQVQLVQSGGGVVQPGRSLRLSCKASGYITFTRYTMHWVRQAPGKGLEWIGYINPSRGYTNYNQKVKGRFTISTDNSKNTAYLQMDSLRAEDTGVYFC ARYYDDHYSLDYWGQGTLVTVSSVEGGSGGSGGSGGSGGVDDIQMTQSPSSLSASVGDRVTITCSASSSVYMNWYQQKPGKAPKRLIYDTSKLASGVPSRFSGSGSGTDYTL | -1 |

TABLE YY-continued

| SEQ ID No. | Clone | Description | Sequence | | |
|---|---|---|---|---|---|
| 1012. | 11177 | Full | TISSLQPEDAATYYCQQWSSNPFTFGQGTKLEIKAAEPKSSDKTHTCPPCPAPEAAGGPSVFLFPPKPKDTLMISRTPEVTCVVVSHEDPEVKFNWYDGVEVHNAKTKPREE QYNSTYRVVSVLTVLHQDWLNGKEYKCKVSNKALPAPIEKTISKAKGQPREPQVVLPPSRDELTKNQVSLLCLVKGFYPSDIAVEWESNGQPENNYLTWPPVLDSDGSFFLYSKL TVDKSRWQQGNVFSCSVMHEALHNHYTQKSLSLSPG | | -1 |
| | | | ATGGAGTTTGGCCTGTCCTGGCTGTTCCTGGTCGCTGCTATCCTGACGGAGCTGTGCAGTCCAAGGCGTGCAGCCTGACGGAGC CTGAGGCTGTCTGCAAGGCCTCCGGATACACCTTCACCCGTACTACATGCATTGGGTGCGACAGGCTCCAGGCCTACATCAATCCCA GCCGGGGATATCAACCTACACACAGAAAGTGAAGGGCCGGTTCACCATCTCCACAGACAACCGGCTATCTGCAAATGGACTCCTGAGGCCGAGG ACACCGGCGTGTACTTTTGCGCTCGGTACTACGACGACCACTACTCCCTGGACTACTGGGGCCAGGGAACCCTGGTGACAGTCTCCTCCGCC AAGCGGAGGCAGCGGAGGATCCGGCGCTATCGAGATGATGAACAAAGCCCGGACCAAGGCTGGCTTCCGGCGTGCTTCCAGTTTC CGGCAGCGGCTCCGGACCAGACCATACACCCACCTGGTCCGCACCAGCATCTCCAAGCCATTGTCCCAGAATCCTCCACCTGTCCGCC AGGGCACCAAGCTGGAGATCAAGCGTACGGTGGCTGCACCATCTGTCTTCATCTTCCCCCCATCTGATGAGCAGTTGAAGTCAACTGTAC GTTCCCCCCCAGCCGTGAGGTGCACAATCGTGCTTCTCCAAGAGTGTCCAAGGAACCATCTCCAAGGCCAAGGGTCAGCCCAGGGAGCCACAG GAACGGCAAGGAGTACAAGTGCAAGGTGTCCAACAAAGCCCTGCCCGCCCCCATCGAGAAGACCATCTCCAAGGCCAAGGGTCAGCCCAGGGAGCCACAG GCTGCCCCCCAGCGGGACGAACTGGCCCGCCCTCCACCCAGGTGTCCCTGACCTGCCTGGTCAAGGGCTTCTACCCCAGCGATATCGCTGTGGAGTGGGAGTCCAACGGCCAG CCGGAGAACAACTACCTGACCTGGCCCCCTGTGCTGGATTCCGATGGCTCCTTCTTCCTGTACTCCAAGCTGACCGTGGACAAGTCCAGGTGGCAGGGCAACGTGTT CTCCTGCTCCGTGATGCACGAGGCCCTGCACAACCACTACACCCAGAAGTCCCTGTCCCTGAGCCCC | | |
| 1013. | 11177 | VH | QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYDDHYSLDYWGQ GTLVTVSS | | Q18-S136 |
| | | | CAAGTGCAGCTGGTGCAGTCCGGAGGAGGAGTGGTGCAGCCTGGACGGAGCCTGAGGCTGTCCTGCAAGGCCTCTGGCTACACCTTCACCCGGTACACCATGCATTGG GTGAGGCAGGCTCCTGGCAAGGGCCTGGAGTGGATCGGCTACATCAATCCCAGCCGGGGATACACAAACTACAACCAGAAAGTGAAGGGCCGGTTCACCATCTCCACC GACAACAGCAAGACCGCCTATCTGCAGATGGACTCCCTGAGAGCCGAGGACACCGGCGTGTACTTTTGCGCTCGGTACTACGACGACCACTACTCCCTGGACTACTGG GGCCAGGGCACCCTGGTGACAGTGTCTCCTCC | | -1 |
| 1014. | 11177 | VH | GYTFTRYT | | G43-T50 |
| 1015. | 11177 | H1 | GGATACACCTTCACCCGGTACACC | | -1 |
| 1016. | 11177 | H1 | ARYYDHYSLDY | | A114-Y125 |
| 1017. | 11177 | H3 | GCTCGGTACTACGACGACCACTACTCCCTGGACTAC | | -1 |
| 1018. | 11177 | H3 | INPSRGYT | | I68-T75 |
| 1019. | 11177 | H2 | ATCAATCCCAGCCGGGGATACACC | | -1 |
| 1020. | 11177 | H2 | DIQMTQSPSSLSASVGDRVTITCSASSSVSYMNWYQQKPGKAPKRLIYDTSKLASGVPSRFSGSGSGTDYTLTISSLQPEDAATYYCQQWSNPFTFGQGTKLEIK | | D155-K260 |
| 1021. | 11177 | VL | GACATCCAGATGACCCAGAGTCCCTCCTCCCTGTCCGCTGGAGACAGGGTGACCATCACCTGCTCCGCCTCCAGCGTGTCCTACATGAACTGGTACCAGCAA AAGCCCGGCAAGGCTCCCGAGCCCCTAAGGCGTTACGACACAAGTGCTTCCGGCGTGCCTCCCGCCCAGCGGCTTCTCCGGCAGCGGCAGCGGCACCAAGGACCACCTGACCA TCAGCAGCCTGCAGCCCGAGGATGCCGCCACCTACTACTGCCAACAACCCTTTCACCTTCGGCCAGGGCACCAAGCTGGAGATCAAG | | -1 |
| 1022. | 11177 | VL | SSVSY | | S181-Y185 |
| 1023. | 11177 | L1 | | | |

TABLE YY-continued

| SEQ ID No. | Clone | Description | Sequence | |
|---|---|---|---|---|
| 1024. | 11177 | L1 | AGCTCCGTGTCCTAC | -1 |
| 1025. | 11177 | L3 | QQWSSNPFT | Q242-T250 |
| 1026. | 11177 | L3 | CAGCAGTGGTCCAGCAACCCTTTCACC | -1 |
| 1027. | 11177 | L2 | DTS | D203-S205 |
| 1028. | 11177 | L2 | GACACAAGC | -1 |
| 1029. | 11177 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A278-K387 |
| 1030. | 11177 | CH2 | GCTCCTGAGGCTGCCGGAGGCCCTTCCGTGTTCCTGTTCCCCCCAAGCCCTAAGGACACCCTGATGATCAGCAGACCCCCGAGGTGACCTGCGTGGTGGTGTCCCACGAGGACCCCGAGGTGAAGTTCAACTGGTACGTGGACGGCGTGGAGGTGCACAACGCCAAGACCAAGCCCAGAGAGGAGCAGTACAACAGCACCTACAGGGTGGTGTCCGTGCTGACCGTGCTGCACCAGGACTGGCTGAACGGCAAGGAGTACAAGTGCAAGGTGTCCAACAAGGCCCTGCCAGCCCCCATCGAGAAGACCATCTCCAAGGCCAAG | -1 |
| 1031. | 11177 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G388-G493 |
| 1032. | 11177 | CH3 | GGCCAGCCCAGGGAACCTCAGGTGTACGTGCTGCCCCCCAGCAGAGAGCTGACCAAGAACCAGGTGTCCCTGACCTGCCTGGTGAAGGGCTTCTACCCCTCCGACATCGCTGTGGAGTGGGAGTCCAACGGCCAGCCCGAGAACAACTACCTGACCTGGCCCCCTGTGCTGGACAGCGACGGCTCCTTCTTCCTGTACTCCAAGCTGACCGTGGACAAGAGCAGGTGGCAGCAGGGCAACGTGTTCTCCTGCTCCGTGATGCACGAGGCCCTGCACAACCACTACACCCAGAAGTCCCTGTCCCTGTCCCCCGGC | -1 |
| 1033. | 11178 | Full | STAIALLALLAVLQGVCSQVLVQSGAEVKKPGASVKISCKASGYAFSSYWMNWVRQAPGQCLEWIGQIWPGDGTNYAQKFQGRATLTADESTSTAYMELSSLRSEDTAVYYCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | -1 |
| 1034. | 11178 | Full | ATGGGATCCACCGCTATCCTGGCTCTCCTGGCTGTCCTGCAGGGCGTGTGCTCCCAGGTGCTGGTGCAGAGCGGCGCTGAAGTGAAGAAGCCCGGCGCCTCCGTGAAGATCTCCTGCAAGGCCTCCGGCTACGCCTTCAGCTCCTACTGGATGAACTGGGTCCAGGCCCCCGGCCAGTGTCTCGAGTGGATCGGCCAGATTTGGCCTGGCGATGGCACCAACTACGCCCAGAAATTCCAGGGCAGGGCCACCCTGACTGCCGATGAGTCTACTACGCCGTATATGGAGCTGAGCTCCCTGAGGAGCGAGGATACTGCCGTGTACTACTGCGGGAGACAGAGACACACCGTGACCGTGAGCTCCGCCAGCACCAAGGGACCTAGCGTGTTCCCTCTGGCTCCCAGCTCCAAGAGCACCAGCGGAGGAACTGCCGCTCTGGGCTGTCTGGTGAAGGACTATTTCCCAGCCCGTGACAGTGGGAACTGGAACATCGGAGTGCACACATTCCCTGCTGTCCTGCAGAGTTCCGGCCTCTACAGCCTGAGCAGCGTGGTGACAGTGCCCAGCAGCAGCCTGGGCACCCAGACCTACATCTGCAACGTGAACCATAAGCCCTCCAACACCAAGGTGGACAAGAAGGTGGAGCCCAAGTCCTGTGACAAGACCCACACCTGCCCCCCTTGTCCTGCTCCTGAAGCTGCCGGAGGTCCTTCCGTGTTCCTGTTCCCCCCTAAGCCTAAGGATACGCTGATGATCAGCAGGACCCCCGAGGTGACTTGCGTGGTCGTGTCCGTGAGCCACGAGGATCCTGAAGTGAAGTTCAACTGGTACGTGGACGGCGTGGAAGTGCACAACGCCAAGACCAAGCCAAGGGAGGAGCAGTACAACAGCACCTACAGGGTCGTGTCCGTGCTGACCGTGCTGCACCAGGACTGGCTGAACGGAAAGGAATACAAGTGCAAAGTCAGCAATAAGGCCCTGCCCGCCCCCATCGAGAAGACCATCTCCAAGGCTAAAGGGCAGCCCCGGGAGCCTCAGGTGTACGTGCTGCCTCCATCCAGGGACGAGCTGACCAAGAATCAGGTGTCACTCACCTGCCTGGTGAAGGGCTTCTACCCCTCCGACATCGCCGTGGAGTGGGAGTCCAATGGCCAACCCGAGAACAACTACCTGACCTGGCCCCCTGTGCTGGATTCCGACGGCTCCTTCTTCCTGTACTCCAAGCTGACCGTGGACAAGAGCAGGTGGCAGCAAGGCAATGTGTTCTCCTGCTCCGTGATGCACGAGGCCCTGCACAACCACTACACCCAGAAGTCCCTGAGTCTGTCCCCTGGC | -1 |

TABLE YY-continued

| SEQ ID NO. | Clone | Description | Sequence | |
|---|---|---|---|---|
| 1035. | 11178 | VH | QVQLVQSGAEVKKPGASVKISCKASGYAFSSYWMNWVRQAPGQCLEWIGQIWPGDGTNYAQKFQGRATLTADESTSTAYMELSLRSEDTAVYYCARRETTTVGRYYYAMDYWGQGTTVTVSS | Q18-S141 |
| 1036. | 11178 | VH | CAGGTCAGCTGGTGCAGAGCGGCGCTGAAGTGAAGAAGCCCGGCGCTAGCGTCAAGATCTCCTGCAAGGCCTCCGGCTACGCCTTTAGCTCCTACTGGATGAACTGGGTCAGGCAGGCTCCCGGCCAGGGCCTCGAGTGGATCGGCCAGATTTGGCCTGGCGACGGCACCAACTACGCCCAGAAATTCCAGGGCCGCGCCACCCTGACCGCTGATGAGTCCACCTCCACCGCCTACATGGAGCTGTCTCTCCCGCTCCGAGGATACCGCCGTGTACTACTGCGCCCGCAGGGAGACCACCACCGTGGGCAGGTACTACTACGCCATGGACTACTGGGGCCAGGGCACCACCGTGACCGTGAGCTCC | -1 |
| 1037. | 11178 | H1 | GYAFSSYW | G43-W50 |
| 1038. | 11178 | H1 | GGCTACGCCTTTAGCTCCTACTGG | -1 |
| 1039. | 11178 | H3 | ARRETTTVGRYYYAMDY | A114-Y130 |
| 1040. | 11178 | H3 | GCCCGGAGGGAGACCACCACCGTGGGCAGGTACTACTACGCCATGGACTAC | -1 |
| 1041. | 11178 | H2 | IWPGDGT | I68-T75 |
| 1042. | 11178 | H2 | ATTTGGCCTGGCGATGGCGACACC | -1 |
| 1043. | 11178 | CH1 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV | A142-V239 |
| 1044. | 11178 | CH1 | GCCAGCACCAAGGGACCCTCCGTGTTTCCCCTGGCTCCCTCCAGTCCACCTCCGGCACCGCTGCTCTGGGCTGCCTGGTGAAGGACTATTTCCCAGCCCGTGACAGTGAGCTGGAACTCCGGCGTGCACACCTTCCCTGCCGTCCTGCAGTCCTCAGGACTCTACAGCCTGAGCAGTGTCGTGACAGTGCCCAGCAGCTCCCTGGGCACCCAGACCTACATCTGCAACGTGAACCACAAACCCTCCAACACCAAAGTGGACAAGAAGGTG | -1 |
| 1045. | 11178 | CH2 | APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK | A255-K364 |
| 1046. | 11178 | CH2 | GCTCCTGAGGCTGCCGGAGGCCCCTCCGTGTTCCTGTTCCCCCCAAGCCCCAAGGACACCCTGATGATCAGCAGGACCCCCGAGGTGACCTGCGTGGTGGTCCGTGAGCCACGAGGACCCCGAGGTCAATCTGTACGTGGACGGCGTGGAGTGCCACAACGCCAAGACAAAGCCCCGGGAGGAGCAGTACAACAGCACCTACAGGGTGGTGTCCGTGCTGACCGTGCTGCACCAGGACTGGCTGAACGGCAAGGAGTACAAGTGCAAAGTCTCCAACAAGGCCCTGCCAGCCCCCATCGAGAAGACCATCTCCAAGGCCAAG | -1 |
| 1047. | 11178 | CH3 | GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG | G365-G470 |
| 1048. | 11178 | CH3 | GGCCAGCCTCGAGAACCTCAGGTGTACGTGCTGCCCCCCCTGAGCAGGGACGAGCTGACCAAGAACCAGGTGTCCCTGCTGTGCCTGGTGAAGGGCTTCTACCCCTCCGACATCGCCGTGGAGTGGGAGTCCAACGGCCAGCCTGAGAACAACTACCTGACCTGGCCCCCCGTGCTGGATTCCGACGGCTCCTTCTTCCTGTACTCCAAGCTGACCGTGGACAAGTCCAGGTGGCAGCAGGGCAACGTGTTCTCCTGCAGCGTGATGCACGAGGCCCTGCACAACCACTACACCCAGAAGTCCCTGTCCCTGAGCCCCGGC | -1 |
| 1049. | 11179 | Full | FGLSWLFLVAILKGVQCQVQLVQSGSGGVVQPGRSLRLSCKASGYTFTRYTMHWVRQAPGKGLEWIGYINPSRGYTNYNQKVKGRFTISTDNSKNTAYLQMDSLRAEDTGVFYCARYYDDHYSLDYWGQTLVTVSSVEGGSGGSGGSGGSGGVDDIQMTQSPSSLSASVGDRVTITCSASSSVYMMNWYQQKPGKAPKLLIYDTSKLASGVPSRFSGSGSGTDYTLTISSLQPEDAATYYCQQWSSNPFFFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVVYYPPSDIAVEWESNGQPENNYKTTPPVLDSDGSFALVSKLTVDKSRWQQGNVFSCSVMHEALHNHYTQKSLSLSPG | -1 |

TABLE YY-continued

| SEQ ID No. | Clone Description | sequence | |
|---|---|---|---|
| 1050. | 11179 Full | ATGGAGTTTGGCTCTCCTGCTGTTTCTGTTGGCTATCCTGAAGGGCGTCGAGTGCCAGTGCAGCTGGTGCAGTCCGGAGGAGGCGTCGTGCAACCTGGCAGGAGCC TGAGGCTGTCCTGCAAGGCCAGCGGCTACACCTTCACCCGGTACACCATGCATTGGGTGAGGCAGGCCCCCGGCAAAGGCCTGGAATGGATCGGCTACATCAACCCTC CAGGGACTACACCAACTACAACCAGAAGTTCAAGGGCCGGTTCACCATCTCCACTGACAACAGCAAGAACACAGCCTACCTGCAGATGGACTCCCTGAGGGCTGAAGAC ACAGGCGTGTATTTCTGCGCCAGGTACTACGACGACCACTACTCCCTGGACTACTGGGGACAGGGCACCCTGGTGACCGTGTCCTCGGAGGAGGATCCGAGGCAT CCTCCTCCGTCTGCTACATGAACTGGTACCAGCAGAAGCCCGGGAAGCCCCCAAGCACCCCAAGCTGCTGATCTACGACGCATCCAAGAGAGCTTCCGGAGTTTAGC GGCAGCGGATCCGGCACCGACTACACCCTGACCATCTCTTCCCTGCAGCCTGAGGATGCCACCTACTATTACTGCCAGCAGTGGTCCAGCAACCCTTCACCTTCGGCCA GGCACAAAGTTGGAGATCAAGGCTGCACCGAGCTGATGATCAAGGACCCCGAGCCTGAGCCGAGGTGAAGTTCAACTGGTACGT GGACGGCGTGGAGGTGCACAATGCTAAGACAAAGCCCAGAGAGGAGCAGTACAACAGCACCTACAGGGTGGTGTCCGTGCTGACCGTGCTGCACCAGGACTGGCTGA ACGGCAAGGAGTACAAGTGCAAGGTCTCCAACAAAGCCCTCCCAGCCCCCATCGAGAAGACCATCTCCAAGGCCAAGGGCCAGCCCCGAGAACCACAGGTGTACACC CTGCCCCCTCCAGGGACGAGCTGACCAAGAACCAGGTGTCCCTGACCTGTCTGGTCAAGGGCTTCTACCCCTCCGACATCGCCGTGGAGTGGGAGAGCAACGGCCAGCC TGAGAACAACTACAAGACCACCCCTCCTGTGCTGGACTCCGACGGCTCCTTCTTCCTGTACAGCAAGCTGACCGTGGACAAGTCCAGGTGGCAGCAGGGCAACGTTC TCCTGCATGCCGTGATGCACGAGGCGCTGCACAACCACTACACCCAGAAGTCCCTGTCCCTGTCCCCC | -1 |
| 1051. | 11179 VH | QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYYDDHYSLDYWGQ GTLVTVSS | Q18-S136 |
| 1052. | 11179 VH | CAGGTGCAGCTCGTGCAGTCCGGAGGAGGCGTCGTGCAACCTGGCAGGAGCCTGAGGCTGTCCTGCAAGGCCAGCGGCTACACCTTCACCCGGTACACCATGCATTGG GTGAGGCAGGCCCCCGGCAAAGGCCTGGAATGGATCGGCTACATCAACCCTCCAGGGACTACACCAACTACAACCAGAAGGTGAAGGGCCGGTTCACCATCTCCACC GACAACTCCAAGAACACAGCCTACCTGCAGATGGACTCCCTGAGGGCTGAAGACACAGGCGTGTATTTCTGCGCCAGGTACTACGACGACCACTACTCCCTGGACTACTG GGGACAGGGCACCCTGGTGACCGTGTCCTCC | -1 |
| 1053. | 11179 H1 | GYTFTRYT | G43-T50 |
| 1054. | 11179 H1 | GGCTACACCTTCACCCGGTACACC | -1 |
| 1055. | 11179 H3 | ARYYDDHYSLDY | A114-Y125 |
| 1056. | 11179 H3 | GCCAGGTACTACGACGACCACTACTCCCTGACTAC | -1 |
| 1057. | 11179 H2 | INPSRGYT | I68-T75 |
| 1058. | 11179 H2 | ATCAACCCTCCAGGGCTACACC | -1 |
| 1059. | 11179 VL | DIQMTQSPSSLSASVGDRVTITCSASSSVSYMNWYQQKPGKAPKRLIYDTSKLASGVPSRFSGSGSGTDYTLTISSLQPEDAATYYCQQWSSNPFTFGQGTKLEIK | D155-K260 |
| 1060. | 11179 VL | GACATCCAGATGACCCAGAGCCCTCCTCCGTGGGAGACCGGGTGACAATCACCTGCAGCGCCTCCTCCGTCTCCTACATGAACTGGTACCAGCA GAAGCCCGGCAAGGCCCCCAAGCTGCTGATCTACGACACATCCAAGCTGGCCTCCGGAGTGCCCTCCAGGTTTAGCGGCAGCGGATCCGGCACCGACTACACCCTGACC ATCTCCTCCCTGCAGCCCGAGGATGCCGCTACTATTACTGCCAGCAGTGGTCCAGCAACCCCTTCACCTTCGGCCAGGGCACAAAGCTGGAGATCAAG | -1 |
| 1061. | 11179 L1 | SSVSY | S181-Y185 |
| 1062. | 11179 L1 | TCCTCCGTGTCCTAC | -1 |

TABLE YY-continued

| SEQ ID No. | Clone | Description | Sequence | |
|---|---|---|---|---|
| 1063. | 11179 | L3 | QQWSSNPFT | Q242-T250 |
| 1064. | 11179 | L3 | CAGCAGTGGTCCAGCAACCCCTTCACC | -1 |
| 1065. | 11179 | L2 | DTS | D203-S205 |
| 1066. | 11179 | L2 | GACACATCC | -1 |
| 1067. | 11179 | CH2 | APEAAGGPSVFLFPPKPKDTLMISRTPEVTCVVVSHEDPEVKFNWYVDGVEVHNAKTKPREEQYNSTYRVVSVLTVLHQDWLNGKEYKCKVSNKALPAPIEKTISKAK | A278-K387 |
| 1068. | 11179 | CH2 | GCTCCTGAGGCTGCCGGAGGCCCCTTCCGTGTTCCTGTTCCCCCCAAGCCCCAAGGACACCCTGATGATCAGCAGGACCCCCGAGGTGACCTGCGTGGTGGTCCGTGAGCCACGAGGACCCCGAGGTGAAGTTCAACTGGTACGTGGACGGCGTGGAAGTGCACAACGCTAAGACCAAGCCTAGAGAGGAGCAGTACAACAGCACCTACAGGGTGGTGTCCGTGCTGACCGTGCTGCACCAGGACTGGCTGAACGGCAAGGAGTACAAGTGCAAGGTGTCCAACAAGGCCCTGCCCGCTCCCATCGAGAAGACCATCTCCAAGGCCAAG | -1 |
| 1069. | 11179 | CH3 | GQPREPQVYTLPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG | G388-G493 |
| 1070. | 11179 | CH3 | GGCCAGCCAAGGGAACCTCAGGTGTACACCCTGCCCCCCTCCAGGGACGAGCTGACCAAGAACCAGGTGTCCCTGACCTGTCTGGTGAAGGGCTTCTACCCCTCCGACATCGCCGTGGAGTGGGAGTCCAACGGCCAGCCTGAGAACAACTACAAGACCACACCCCCTGTGCTGGACTCCGACGGCTCCTTCGCCCTGGTGTCCAAGCTGACCGTGGACAAGTCCAGGTGGCAGCAGGGCAACGTGTTCTCCTGCTCCGTGATGCACGAGGCCCTGCACAACCACTACACCCAGAAGTCCCTGTCCCTGTCCCCCGGC | -1 |
| 1071. | 11175 | Full | DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | -1 |
| 1072. | 11175 | Full | GACATTCAGCTGACCCAGAGCCCCTTCCCTGAGCCTGAGCGTGGGAGACCGGCCACAATCACCTGCAGGGCCAGCGCCAATCGTGGACTACGAGGGCGACTCCTACCTGAACTGGTATCAGCAGAAGCCCGGCAAGGCCCCCAAGCTGCTGATCTACGACGCCTGATCTACGACGCCTCCAACCTGGTGTCCGGCATCCCTTCCAGGTTTAGCGGCTCCGGCAGCGGCACCGATTTCACCCTGACCATCAGCAGCCTGCAGCCTGAGGACGCTGCCACCTACTGCCAGCAGAGCACCGAGGACCCCTGGACCTTCGGCTGTGGCACAAAGCTGGAG | -1 |

TABLE YY-continued

| SEQ ID No. | Clone | Description | Sequence | |
|---|---|---|---|---|
| 1073. | 11175 | VL | ATCAAGAGGACCTGGCCGCTCCCTCCGTGTTCATCTTCCCCCCAGCGATGAACAGCTGAAGTCCGGCACAGCTTCCGTGTGCCTGCTCCTCTACCCCAGG GAAGCCAAGGTGCAGTGGAAAGTTGATAACGCCCTGCAGAGCGGCAACTCCCAGGAGTCCGTGACAGAGCAGGACAGCAAGGACTCCACCTACTCCCTGTCCTCCACCC TGACCCTGTCCAAGGCCGATTACGAGAAGCACAAGGTGTACGCCTGCGAAGTGACACACCAGGGCCTGTCCTCCCCCGTGACCAAGTCCTTCAACAGGGGCGAG | D1-K111 |
| 1074. | 11175 | VL | DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIK | -1 |
|  | 11175 | VL | GACATTCAGCTGACCCAGAGCCCTTCCTCCCTGAGCGCCAGCGTGGGAGACCGGGCCACAATCACCTGCAGGGCCAGCCAATCCGTGGACTACGAGGGCGACTCCTACC TGAACTGGTATCAGCAGAAGCCCGGCAAGGCCCCTAAGCTGCTGATCTACGACGCCTCCAATCTCCAACCTGGTCCCGGCATCTCCAGGTTTAGCGGCTCCGGCAGCGGCAC CGATTTCACCCTGACCATCAGCAGCGTGCAGCCTGAGGACGCTGCCACCTACTACTGCCAGCAGAGCACCGAGGACCCCTGGACCTTCGGCTGTGCCACAAAGTTGGAG ATCAAG | |
| 1075. | 11175 | L1 | QSVDYEGDSY | Q27-Y36 |
| 1076. | 11175 | L1 | CAATCCGTGGACTACGAGGGCGACTCCTAC | -1 |
| 1077. | 11175 | L3 | QQSTEDPWT | Q93-T101 |
| 1078. | 11175 | L3 | CAGCAGAGCACCGAGGACCCCTGGACC | -1 |
| 1079. | 11175 | L2 | DAS | D54-S56 |
| 1080. | 11175 | L2 | GACGCCTCC | -1 |
| 1081. | 11175 | CL | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | R112-C218 |
| 1082. | 11175 | CL | AGGACCGTGGCCGCTCCCTCCGTGTTCATCTTCCCCCCAGCGATGAACAGCTGAAGTCCGGCACAGCTTCCGTGTGCCTGCTCAACAACTTCTACCCCAGGGAAGC CAAGGTGCAGTGGAAAGTTGATAACGCCCTGCAGAGCGGCAACTCCCAGGAGTCCGTGACAGAGCAGGACAGCAAGGACTCCACCTACTCCCTGTCCTCCACCCTGACC CTGTCCAAGGCCGATTACGAGAAGCACAAGGTGTACGCCTGCGAGGTGACACACCAGGGCCTGTCCTCCCCCGTGACCAAGTCCTTCAACAGGGGCGAGTGC | -1 |

SEQUENCE LISTING (1183 sequences)

SEQ ID NO: 1 - protein, 474 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 2 - DNA, 1422 bp, Artificial Sequence
  Description of Artificial Sequence: Synthetic polynucleotide
cagatcgtcctgacacagagcccagctatcatgtcagcaagccccggcgagaaagtcacaatgacttgctcagccagctcctctgtgagctacatgaactggtatcagcagaaaagcggaacctcccccaagagatggatctacgacacatccaagctggcctctggagtgcctgctcacttcaggggcagcggctctgggaccagttattcactgacaatttccggcatggaggccgaagatgccgctacctactattgccagcagtggagttcaaacccattcacttttggatctggcaccaagctggaaattaatggcggaggaggctccggaggaggagggtctggaggaggaggaagtcaggtgcagctgcagcagtccggagcagagctggctcgaccaggagctagtgtgaaaatgtcctgtaaggcaagcggctacaccttcacacggtataccatgcattgggtgaaacagagacccgggcagggactggaatggatcgggtacattaatcctagccgaggatacacaaactacaaccagaagtttaaagacaaggccactctgaccacagataagagctcctctaccgcttatatgcagctgagttcactgacatctgaggacagtgcagtgtactattgcgccaggtactatgacgatcactactgtctggattattggggccaggggactaccctgacagtgagctccgcagccgaacctaaatctagtgacaagactcatacctgccccccttgtccagcaccagaggctgcaggaggaccttccgtgttcctgtttccacccaaaccaaaggatactctgatgatctcccggacacctgaagtcacttgcgtggtcgtgagcgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggcactgcctgccccaatcgagaagacaattagcaaagcaaaggggcagccccgagaacctcaggtctacgtgctgcctccatctcgggacgagctgactaaaaaccaggtcagtctgctgtgtctggtgaagggcttctatccaagcgatattgctgtggagtgggaatccaatgggcagcccgaaaacaattacctgacttggccccctgtcctggactcagatgggagcttctttctgtatagtaaactgaccgtggacaagtcacggtggcagcagggaaacgtctttagctgttccgtgatgcatgaggccctgcacaatcattacacccagaaatctctgagtctgtcacccggcaag

SEQ ID NO: 3 - protein, 106 aa, Artificial Sequence [sequence omitted]

SEQ ID NO: 4 - DNA, 318 bp, Artificial Sequence
  Description of Artificial Sequence: Synthetic polynucleotide
cagatcgtcctgacacagagcccagctatcatgtcagcaagccccggcgagaaagtcacaatgacttgctcagccagctcctctgtgagctacatgaactggtatcagcagaaaagcggaacctcccccaagagatggatctacgacacatccaagctggcctctggagtgcctgctcacttcaggggcagcggctctgggaccagttattcactgacaatttccggcatggaggccgaagatgccgctacctactattgccagcagtggagttcaaacccattcacttttggatctggcaccaagctggaaattaat

SEQ ID NO: 5 - protein, 5 aa, Artificial Sequence
  Description of Artificial Sequence: Synthetic peptide
SSVSY

SEQ ID NO: 6 - DNA, 15 bp, Artificial Sequence
  Description of Artificial Sequence: Synthetic oligonucleotide
tcctctgtgagctac

SEQ ID NO: 7 - protein, 9 aa, Artificial Sequence
  Description of Artificial Sequence: Synthetic peptide
QQWSSNPFT

SEQ ID NO: 8 - DNA, 27 bp, Artificial Sequence
  Description of Artificial Sequence: Synthetic oligonucleotide
cagcagtggagttcaaacccattcact

SEQ ID NO: 9 - protein, 3 aa, Artificial Sequence
  Description of Artificial Sequence: Synthetic peptide
DTS

SEQ ID NO: 10 - DNA, 9 bp, Artificial Sequence
  Description of Artificial Sequence: Synthetic oligonucleotide
gacacatcc

SEQ ID NO: 11 - protein, 119 aa, Artificial Sequence [sequence omitted]

SEQ ID NO: 12 - DNA, 357 bp, Artificial Sequence
  Description of Artificial Sequence: Synthetic polynucleotide
caggtgcagctgcagcagtccggagcagagctggctcgaccaggagctagtgtgaaaatgtcctgtaaggcaagcggctacaccttcacacggtataccatgcattgggtgaaacagagacccgggcagggactggaatggatcgggtacattaatcctagccgaggatacacaaactacaaccagaagtttaaagacaaggccactctgaccacagataagagctcctctaccgcttatatgcagctgagttcactgacatctgaggacagtgcagtgtactattgcgccaggtactatgacgatcactactgtctggattattggggccaggggactaccctgacagtgagctcc

SEQ ID NO: 13 - protein, 8 aa, Artificial Sequence
  Description of Artificial Sequence: Synthetic peptide
GYTFTRYT

SEQ ID NO: 14 - DNA, 24 bp, Artificial Sequence
  Description of Artificial Sequence: Synthetic oligonucleotide
ggctacaccttcacacggtatacc

SEQ ID NO: 15 - protein, 12 aa, Artificial Sequence
  Description of Artificial Sequence: Synthetic peptide
ARYYDDHYCLDY

SEQ ID NO: 16 - DNA, 36 bp, Artificial Sequence
  Description of Artificial Sequence: Synthetic oligonucleotide
gccaggtactatgacgatcactactgtctggattat

SEQ ID NO: 17 - protein, 8 aa, Artificial Sequence
  Description of Artificial Sequence: Synthetic peptide
INPSRGYT

SEQ ID NO: 18 - DNA, 24 bp, Artificial Sequence
  Description of Artificial Sequence: Synthetic oligonucleotide
attaatcctagccgaggatacaca

SEQ ID NO: 19 - protein, 110 aa, Artificial Sequence
  Description of Artificial Sequence: Synthetic polypeptide
APEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAK

SEQ ID NO: 20 - DNA, 330 bp, Artificial Sequence
  Description of Artificial Sequence: Synthetic polynucleotide
gcaccagaggctgcaggaggaccttccgtgttcctgtttccacccaaaccaaaggatactctgatgatctcccggacacctgaagtcacttgcgtggtcgtgagcgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggcactgcctgccccaatcgagaagacaattagcaaagcaaag

SEQ ID NO: 21 - protein, 106 aa, Artificial Sequence
  Description of Artificial Sequence: Synthetic polypeptide
GQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 22 - DNA, 318 bp, Artificial Sequence
  Description of Artificial Sequence: Synthetic polynucleotide
gggcagccccgagaacctcaggtctacgtgctgcctccatctcgggacgagctgactaaaaaccaggtcagtctgctgtgtctggtgaagggcttctatccaagcgatattgctgtggagtgggaatccaatgggcagcccgaaaacaattacctgacttggccccctgtcctggactcagatgggagcttctttctgtatagtaaactgaccgtggacaagtcacggtggcagcagggaaacgtctttagctgttccgtgatgcatgaggccctgcacaatcattacacccagaaatctctgagtctgtcacccggc

SEQ ID NO: 23 - protein, 474 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 24 - DNA, 1422 bp, Artificial Sequence
  Description of Artificial Sequence: Synthetic polynucleotide
cagatcgtcctgacacagagcccagctatcatgtcagcaagccccggcgagaaagtcacaatgacttgctcagccagctcctctgtgagctacatgaactggtatcagcagaaaagcggaacctcccccaagagatggatctacgacacatccaagctggcctctggagtgcctgctcacttcaggggcagcggctctgggaccagttattcactgacaatttccggcatggaggccgaagatgccgctacctactattgccagcagtggagttcaaacccattcacttttggatctggcaccaagctggaaattaatggcggaggaggctccggaggaggagggtctggaggaggaggaagtcaggtgcagctgcagcagagcggagcagagctggctcgaccaggagctagtgtgaaaatgtcctgtaaggcaagcggctacaccttcacacggtataccatgcattgggtgaaacagagacccgggcagggactggaatggatcgggtacattaatccttcccgaggatacacaaactacaaccagaagtttaaagacaaggccactctgaccacagataagagctcctctaccgcttatatgcagctgagttcactgacatctgaggacagtgcagtgtactattgcgccaggtactatgacgatcactactccctggattattggggccaggggactaccctgacagtgagctccgcagccgaacctaaatctagtgacaagactcatacctgccccccttgtccagcaccagaggctgcaggaggacctagcgtgttcctgtttccacccaaaccaaaggatactctgatgatctcccggacacctgaagtcacttgtgtggtcgtgagcgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggcactgcctgccccaatcgagaagacaattagcaaagcaaaggggcagccccgagaacctcaggtctacgtgctgcctccatctcgggacgagctgactaaaaaccaggtcagtctgctgtgtctggtgaagggcttctatccaagcgatattgctgtggagtgggaatccaatgggcagcccgaaaacaattacctgacttggccccctgtcctggactcagatgggagcttctttctgtatagtaaactgaccgtggacaagtcacggtggcagcagggaaacgtctttagctgttccgtgatgcatgaggccctgcacaatcattacacccagaaatctctgagtctgtcacccggcaag

SEQ ID NO: 25 - protein, 106 aa, Artificial Sequence [sequence omitted]

SEQ ID NO: 26 - DNA, 318 bp, Artificial Sequence; identical to SEQ ID NO: 4
  Description of Artificial Sequence: Synthetic polynucleotide

SEQ ID NO: 27 - protein, 5 aa, Artificial Sequence
  Description of Artificial Sequence: Synthetic peptide
SSVSY

SEQ ID NO: 28 - DNA, 15 bp, Artificial Sequence
  Description of Artificial Sequence: Synthetic oligonucleotide
tcctctgtgagctac

SEQ ID NO: 29 - protein, 9 aa, Artificial Sequence
  Description of Artificial Sequence: Synthetic peptide
QQWSSNPFT

SEQ ID NO: 30 - DNA, 27 bp, Artificial Sequence
  Description of Artificial Sequence: Synthetic oligonucleotide
cagcagtggagttcaaacccattcact

SEQ ID NO: 31 - protein, 3 aa, Artificial Sequence
  Description of Artificial Sequence: Synthetic peptide
DTS

SEQ ID NO: 32 - DNA, 9 bp, Artificial Sequence
  Description of Artificial Sequence: Synthetic oligonucleotide
gacacatcc

SEQ ID NO: 33 - protein, 119 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSS

SEQ ID NO: 34 - DNA, 357 bp, Artificial Sequence
  Description of Artificial Sequence: Synthetic polynucleotide
caggtgcagctgcagcagagcggagcagagctggctcgaccaggagctagtgtgaaaatgtcctgtaaggcaagcggctacaccttcacacggtataccatgcattgggtgaaacagagacccgggcagggactggaatggatcgggtacattaatccttcccgaggatacacaaactacaaccagaagtttaaagacaaggccactctgaccacagataagagctcctctaccgcttatatgcagctgagttcactgacatctgaggacagtgcagtgtactattgcgccaggtactatgacgatcactactccctggattattggggccaggggactaccctgacagtgagctcc

SEQ ID NO: 35 - protein, 8 aa, Artificial Sequence
  Description of Artificial Sequence: Synthetic peptide
GYTFTRYT

SEQ ID NO: 36 - DNA, 24 bp, Artificial Sequence
  Description of Artificial Sequence: Synthetic oligonucleotide
ggctacaccttcacacggtatacc

SEQ ID NO: 37 - protein, 12 aa, Artificial Sequence
  Description of Artificial Sequence: Synthetic peptide
ARYYDDHYSLDY

SEQ ID NO: 38 - DNA, 36 bp, Artificial Sequence
  Description of Artificial Sequence: Synthetic oligonucleotide
gccaggtactatgacgatcactactccctggattat

SEQ ID NO: 39 - protein, 8 aa, Artificial Sequence
  Description of Artificial Sequence: Synthetic peptide
INPSRGYT

SEQ ID NO: 40 - DNA, 24 bp, Artificial Sequence
  Description of Artificial Sequence: Synthetic oligonucleotide
attaatccttcccgaggatacaca

SEQ ID NO: 41 - protein, 110 aa, Artificial Sequence; identical to SEQ ID NO: 19
  Description of Artificial Sequence: Synthetic polypeptide

SEQ ID NO: 42 - DNA, 330 bp, Artificial Sequence
  Description of Artificial Sequence: Synthetic polynucleotide
gcaccagaggctgcaggaggacctagcgtgttcctgtttccacccaaaccaaaggatactctgatgatctcccggacacctgaagtcacttgtgtggtcgtgagcgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggcactgcctgccccaatcgagaagacaattagcaaagcaaag

SEQ ID NO: 43 - protein, 106 aa, Artificial Sequence; identical to SEQ ID NO: 21
  Description of Artificial Sequence: Synthetic polypeptide

SEQ ID NO: 44 - DNA, 318 bp, Artificial Sequence; identical to SEQ ID NO: 22
  Description of Artificial Sequence: Synthetic polynucleotide

SEQ ID NO: 45 - protein, 213 aa, Artificial Sequence
  Description of Artificial Sequence: Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - DNA, 639 bp, Artificial Sequence
  Description of Artificial Sequence: Synthetic polynucleotide
gatattcagatgacccagagcccaagctccctgagtgcctcagtgggcgaccgagtcaccatcacatgctccgcttctagttcagtgtcttacatgaactggtatcagcagactccagggaaggcacccaaacggtggatctacgatacctcaaagctggccagcggagtgccctccagattcagcggctccgggtctggaacagactatacttttaccatcagctccctgcagcctgaggatattgctacttactattgccagcagtggtctagtaatccattcacttttggccaggggaccaagctgcagatcacaaggactgtggccgctcccagcgtcttcatttttccccctagcgacgagcagctgaaatctggcacagccagtgtggtctgtctgctgaacaatttctaccctcgcgaagcaaaggtgcagtggaaagtcgataacgccctgcagagtggcaacagccaggagagcgtgacagaacaggactccaaggattctacttatagtctgtcaagcaccctgacactgtccaaagctgactacgagaagcacaaagtgtatgcatgcgaagtcacccatcagggactgtcctctcctgtgacaaaatcttttaacagaggcgaatgt

SEQ ID NO: 47 - protein, 106 aa, Artificial Sequence [sequence omitted]

SEQ ID NO: 48 - DNA, 318 bp, Artificial Sequence
  Description of Artificial Sequence: Synthetic polynucleotide
gatattcagatgacccagagcccaagctccctgagtgcctcagtgggcgaccgagtcaccatcacatgctccgcttctagttcagtgtcttacatgaactggtatcagcagactccagggaaggcacccaaacggtggatctacgatacctcaaagctggccagcggagtgccctccagattcagcggctccgggtctggaacagactatacttttaccatcagctccctgcagcctgaggatattgctacttactattgccagcagtggtctagtaatccattcacttttggccaggggaccaagctgcagatcaca

SEQ ID NO: 49 - protein, 5 aa, Artificial Sequence
  Description of Artificial Sequence: Synthetic peptide
SSVSY

SEQ ID NO: 50 - DNA, 15 bp, Artificial Sequence
  Description of Artificial Sequence: Synthetic oligonucleotide
agttcagtgtcttac

SEQ ID NO: 51 - protein, 9 aa, Artificial Sequence
  Description of Artificial Sequence: Synthetic peptide
QQWSSNPFT

SEQ ID NO: 52 - DNA, 27 bp, Artificial Sequence
  Description of Artificial Sequence: Synthetic oligonucleotide
cagcagtggtctagtaatccattcact

SEQ ID NO: 53 - protein, 3 aa, Artificial Sequence
  Description of Artificial Sequence: Synthetic peptide
DTS

SEQ ID NO: 54 - DNA, 9 bp, Artificial Sequence
  Description of Artificial Sequence: Synthetic oligonucleotide
gatacctca

SEQ ID NO: 55 - protein, 107 aa, Artificial Sequence [sequence omitted]

SEQ ID NO: 56 - DNA, 321 bp, Artificial Sequence
  Description of Artificial Sequence: Synthetic polynucleotide
aggactgtggccgctcccagcgtcttcatttttccccctagcgacgagcagctgaaatctggcacagccagtgtggtctgtctgctgaacaatttctaccctcgcgaagcaaaggtgcagtggaaagtcgataacgccctgcagagtggcaacagccaggagagcgtgacagaacaggactccaaggattctacttatagtctgtcaagcaccctgacactgtccaaagctgactacgagaagcacaaagtgtatgcatgcgaagtcacccatcagggactgtcctctcctgtgacaaaatcttttaacagaggcgaatgt

SEQ ID NO: 57 - protein, 218 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 58 - DNA, 654 bp, Artificial Sequence
  Description of Artificial Sequence: Synthetic polynucleotide
gatattcagctgactcagtcacccgctagcctggcagtgagtctgggccagagggccaccatcagctgcaaggcttcacagagcgtcgactacgatggcgacagctacctgaactggtatcagcagatccctgggcagccccctaaactgctgatctacgacgcctctaatctggtgagtggcatccccccacgcttctccggctctgggagtggaactgattttaccctgaacattcaccccgtggagaaggtcgacgccgctacataccattgccagcagtccacagaggacccctggactttcggcgggggaaccaagctggaaatcaaacggacagtggcagccccatccgtcttcatttttcctccatctgacgagcagctgaaatcagggactgctagcgtggtctgtctgctgaacaatttttacccaagagaagcaaaggtgcagtggaaagtcgataacgccctgcagtccggaaattctcaggagagtgtgacagaacaggattcaaaggacagcacttattccctgagctccaccctgacactgtccaaagctgattacgagaagcacaaagtgtatgcatgcgaagtcacccatcagggactgtctagtcccgtgacaaagtctttcaatcgaggcgaatgt

SEQ ID NO: 59 - protein, 111 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 60 - DNA, 333 bp, Artificial Sequence
  Description of Artificial Sequence: Synthetic polynucleotide
gatattcagctgactcagtcacccgctagcctggcagtgagtctgggccagagggccaccatcagctgcaaggcttcacagagcgtcgactacgatggcgacagctacctgaactggtatcagcagatccctgggcagccccctaaactgctgatctacgacgcctctaatctggtgagtggcatccccccacgcttctccggctctgggagtggaactgattttaccctgaacattcaccccgtggagaaggtcgacgccgctacataccattgccagcagtccacagaggacccctggactttcggcgggggaaccaagctggaaatcaaa

SEQ ID NO: 61 - protein, 10 aa, Artificial Sequence
  Description of Artificial Sequence: Synthetic peptide
QSVDYDGDSY

SEQ ID NO: 62 - DNA, 30 bp, Artificial Sequence
  Description of Artificial Sequence: Synthetic oligonucleotide
cagagcgtcgactacgatggcgacagctac

SEQ ID NO: 63 - protein, 9 aa, Artificial Sequence
  Description of Artificial Sequence: Synthetic peptide
QQSTEDPWT

SEQ ID NO: 64 - DNA, 27 bp, Artificial Sequence
  Description of Artificial Sequence: Synthetic oligonucleotide
cagcagtccacagaggacccctggact

SEQ ID NO: 65 - protein, 3 aa, Artificial Sequence
  Description of Artificial Sequence: Synthetic peptide
DAS

SEQ ID NO: 66 - DNA, 9 bp, Artificial Sequence
  Description of Artificial Sequence: Synthetic oligonucleotide
gacgcctct

SEQ ID NO: 67 - protein, 107 aa, Artificial Sequence [sequence omitted]

SEQ ID NO: 68 - DNA, 321 bp, Artificial Sequence
  Description of Artificial Sequence: Synthetic polynucleotide
cggacagtggcagccccatccgtcttcatttttcctccatctgacgagcagctgaaatcagggactgctagcgtggtctgtctgctgaacaatttttacccaagagaagcaaaggtgcagtggaaagtcgataacgccctgcagtccggaaattctcaggagagtgtgacagaacaggattcaaaggacagcacttattccctgagctccaccctgacactgtccaaagctgattacgagaagcacaaagtgtatgcatgcgaagtcacccatcagggactgtctagtcccgtgacaaagtctttcaatcgaggcgaatgt

SEQ ID NO: 69 - protein, 484 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 70 - DNA, 1452 bp, Artificial Sequence
  Description of Artificial Sequence: Synthetic polynucleotide
gatattcagctgacacagagtcctgcatcactggctgtgagcctgggacagcgagcaactatctcctgcaaagccagtcagtcagtggactatgatggcgactcctatctgaactggtaccagcagatcccagggcagccccctaagctgctgatctacgacgcctcaaatctggtgagcggcatcccaccacgattcagcggcagcggctctgggactgattttaccctgaacattcacccagtcgagaaggtggacgccgctacctaccattgccagcagtctaccgaggacccctggacattcggcgggggaactaaactggaaatcaagggaggaggaggcagtggcggaggagggtcaggaggaggaggaagccaggtgcagctgcagcagagcggagcagagctggtcagaccaggaagctccgtgaaaatttcctgtaaggcttctggctatgcattttctagttactggatgaattgggtgaagcagaggccaggacagggcctggaatggatcgggcagatttggcccggggatggagacaccaactataatggaaagttcaaaggcaaggccacactgactgctgacgagtcaagctccacagcctatatgcagctgtctagtctggcaagcgaggattccgccgtgtacttttgcgctcggagagaaaccacaactgtgggcaggtactattacgctatggactactggggccaggggaccacagtcaccgtgtcaagcgcagccgaacccaaatcctctgataagacccacacatgccctccatgtccagctcctgaggctgcaggaggaccaagcgtgttcctgtttccccctaaacctaaggacacactgatgatctctcggacacccgaagtcacttgtgtggtcgtgagcgtgagccacgaggaccctgaagtcaaattcaactggtacgtggatggcgtcgaggtgcataatgccaaaactaagcctagggaggaacagtataactccacttaccgcgtcgtgtctgtcctgaccgtgctgcatcaggactggctgaacggaaaggagtacaaatgcaaggtgagcaacaaggcactgccagcccccatcgagaagacaatttccaaagcaaagggccagcctcgagaaccacaggtctatgtgtacccacccagccgggacgagctgaccaaaaaccaggtctccctgacatgtctggtgaagggattttatccttctgatattgccgtggagtgggaaagtaatggccagccagaaaacaattacaagactacccctccagtgctggattctgacgggagtttcgctctggtcagtaaactgactgtggataagtcacggtggcagcagggaaacgtctttagttgttcagtgatgcacgaggcactgcacaatcattacacccagaaaagcctgtccctgtctcccggcaag

SEQ ID NO: 71 - protein, 111 aa, Artificial Sequence; identical to SEQ ID NO: 59
  Description of Artificial Sequence: Synthetic polypeptide

SEQ ID NO: 72 - DNA, 333 bp, Artificial Sequence
  Description of Artificial Sequence: Synthetic polynucleotide
gatattcagctgacacagagtcctgcatcactggctgtgagcctgggacagcgagcaactatctcctgcaaagccagtcagtcagtggactatgatggcgactcctatctgaactggtaccagcagatcccagggcagccccctaagctgctgatctacgacgcctcaaatctggtgagcggcatcccaccacgattcagcggcagcggctctgggactgattttaccctgaacattcacccagtcgagaaggtggacgccgctacctaccattgccagcagtctaccgaggacccctggacattcggcgggggaactaaactggaaatcaag

SEQ ID NO: 73 - protein, 10 aa, Artificial Sequence
  Description of Artificial Sequence: Synthetic peptide
QSVDYDGDSY

SEQ ID NO: 74 - DNA, 30 bp, Artificial Sequence
  Description of Artificial Sequence: Synthetic oligonucleotide
cagtcagtggactatgatggcgactcctat

SEQ ID NO: 75 - protein, 9 aa, Artificial Sequence
  Description of Artificial Sequence: Synthetic peptide
QQSTEDPWT

SEQ ID NO: 76 - DNA, 27 bp, Artificial Sequence
  Description of Artificial Sequence: Synthetic oligonucleotide
cagcagtctaccgaggacccctggaca

SEQ ID NO: 77 - protein, 3 aa, Artificial Sequence
  Description of Artificial Sequence: Synthetic peptide
DAS

SEQ ID NO: 78 - DNA, 9 bp, Artificial Sequence
  Description of Artificial Sequence: Synthetic oligonucleotide
gacgcctca

SEQ ID NO: 79 - protein, 124 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 80 - DNA, 372 bp, Artificial Sequence
  Description of Artificial Sequence: Synthetic polynucleotide
caggtgcagctgcagcagagcggagcagagctggtcagaccaggaagctccgtgaaaatttcctgtaaggcttctggctatgcattttctagttactggatgaattgggtgaagcagaggccaggacagggcctggaatggatcgggcagatttggcccggggatggagacaccaactataatggaaagttcaaaggcaaggccacactgactgctgacgagtcaagctccacagcctatatgcagctgtctagtctggcaagcgaggattccgccgtgtacttttgcgctcggagagaaaccacaactgtgggcaggtactattacgctatggactactggggccaggggaccacagtcaccgtgtcaagc

SEQ ID NO: 81 - protein, 8 aa, Artificial Sequence
  Description of Artificial Sequence: Synthetic peptide
GYAFSSYW

SEQ ID NO: 82 - DNA, 24 bp, Artificial Sequence
  Description of Artificial Sequence: Synthetic oligonucleotide
ggctatgcattttctagttactgg

SEQ ID NO: 83 - protein, 17 aa, Artificial Sequence
  Description of Artificial Sequence: Synthetic peptide
ARRETTTVGRYYYAMDY

SEQ ID NO: 84 - DNA, 51 bp, Artificial Sequence
  Description of Artificial Sequence: Synthetic oligonucleotide
gctcggagagaaaccacaactgtgggcaggtactattacgctatggactac

SEQ ID NO: 85 - protein, 8 aa, Artificial Sequence
  Description of Artificial Sequence: Synthetic peptide
IWPGDGDT

SEQ ID NO: 86 - DNA, 24 bp, Artificial Sequence
  Description of Artificial Sequence: Synthetic oligonucleotide
atttggcccggggatggagacacc

SEQ ID NO: 87 - protein, 110 aa, Artificial Sequence; identical to SEQ ID NO: 19
  Description of Artificial Sequence: Synthetic polypeptide

SEQ ID NO: 88 - DNA, 330 bp, Artificial Sequence
  Description of Artificial Sequence: Synthetic polynucleotide
gctcctgaggctgcaggaggaccaagcgtgttcctgtttccccctaaacctaaggacacactgatgatctctcggacacccgaagtcacttgtgtggtcgtgagcgtgagccacgaggaccctgaagtcaaattcaactggtacgtggatggcgtcgaggtgcataatgccaaaactaagcctagggaggaacagtataactccacttaccgcgtcgtgtctgtcctgaccgtgctgcatcaggactggctgaacggaaaggagtacaaatgcaaggtgagcaacaaggcactgccagcccccatcgagaagacaatttccaaagcaaag

SEQ ID NO: 89 - protein, 106 aa, Artificial Sequence
  Description of Artificial Sequence: Synthetic polypeptide
GQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 90 - DNA, 318 bp, Artificial Sequence
  Description of Artificial Sequence: Synthetic polynucleotide
ggccagcctcgagaaccacaggtctatgtgtacccacccagccgggacgagctgaccaaaaaccaggtctccctgacatgtctggtgaagggattttatccttctgatattgccgtggagtgggaaagtaatggccagccagaaaacaattacaagactacccctccagtgctggattctgacgggagtttcgctctggtcagtaaactgactgtggataagtcacggtggcagcagggaaacgtctttagttgttcagtgatgcacgaggcactgcacaatcattacacccagaaaagcctgtccctgtctcccggc

SEQ ID NO: 91 - protein, 480 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSSSTGGGGSGGGGSGGGGSDIQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 92 - DNA, 1440 bp, Artificial Sequence
  Description of Artificial Sequence: Synthetic polynucleotide
caggtccagctgcagcagagcggagcagagctggctcgaccaggagctagtgtgaaaatgtcatgcaaggcaagcggctacaccttcacacggtatactatgcactgggtgaaacagagacccggacagggcctggaatggatcgggtacattaaccctagccgaggatacaccaactacaaccagaagtttaaagacaaggccaccctgaccacagataagagctcctctacagcttatatgcagctgagttcactgacttctgaggacagtgccgtgtactattgtgctcggtactatgacgatcattactccctggattattgggggcagggaactaccctgaccgtgagctcctctagtacaggaggaggaggcagtggaggaggagggtcaggcggaggaggaagcgacatccagattgtgctgacacagtctccagctatcatgtccgcatctcccggcgagaaagtcactatgacctgctccgcctcaagctccgtgtcttacatgaattggtatcagcagaaatcaggaaccagccccaagagatggatctacgacacatccaagctggcatctggagtgcctgcacacttcaggggcagtgggtcaggaactagctattccctgaccattagcggcatggaggccgaagatgccgctacctactattgtcagcagtggtctagtaacccattcacatttggcagcgggactaagctggagatcaatagggcagccgaacccaaatcaagcgacaagacacatacttgccccccttgtccagctccagaagctgcaggaggaccttccgtgttcctgtttccacccaaaccaaaggatacactgatgattagccgcacccctgaggtcacatgcgtggtcgtgagcgtgagccacgaggaccccgaagtcaagttcaactggtacgtggacggcgtcgaagtgcataatgccaaaaccaagcctagggaggaacagtacaacagtacatatagagtcgtgtcagtgctgaccgtcctgcaccaggattggctgaacggcaaggagtacaaatgcaaggtgtccaacaaggcactgcctgccccaatcgagaagaccatttctaaagctaaggggcagccccgagaacctcaggtctacgtgtatcctccatcccgggacgagctgactaaaaaccaggtctctctgacctgtctggtgaagggcttttacccatctgatattgcagtcgagtgggaaagtaatgggcagcccgagaacaattataagacaactccccctgtgctggactccgatgggtctttcgcactggtcagcaaactgacagtggataagtccagatggcagcagggaaacgtcttttcttgtagtgtgatgcatgaagccctgcacaatcattacactcagaaatcactgagcctgtcccccggcaag

SEQ ID NO: 93 - protein, 119 aa, Artificial Sequence; identical to SEQ ID NO: 33
  Description of Artificial Sequence: Synthetic polypeptide

SEQ ID NO: 94 - DNA, 357 bp, Artificial Sequence
  Description of Artificial Sequence: Synthetic polynucleotide
caggtccagctgcagcagagcggagcagagctggctcgaccaggagctagtgtgaaaatgtcatgcaaggcaagcggctacaccttcacacggtatactatgcactgggtgaaacagagacccggacagggcctggaatggatcgggtacattaaccctagccgaggatacaccaactacaaccagaagtttaaagacaaggccaccctgaccacagataagagctcctctacagcttatatgcagctgagttcactgacttctgaggacagtgccgtgtactattgtgctcggtactatgacgatcattactccctggattattgggggcagggaactaccctgaccgtgagctcc

SEQ ID NO: 95 - protein, 8 aa, Artificial Sequence
  Description of Artificial Sequence: Synthetic peptide
GYTFTRYT

SEQ ID NO: 96 - DNA, 24 bp, Artificial Sequence
  Description of Artificial Sequence: Synthetic oligonucleotide
ggctacaccttcacacggtatact

SEQ ID NO: 97 - protein, 12 aa, Artificial Sequence
  Description of Artificial Sequence: Synthetic peptide
ARYYDDHYSLDY

SEQ ID NO: 98 - DNA, 36 bp, Artificial Sequence
  Description of Artificial Sequence: Synthetic oligonucleotide
gctcggtactatgacgatcattactccctggattat

SEQ ID NO: 99 - protein, 8 aa, Artificial Sequence
  Description of Artificial Sequence: Synthetic peptide
INPSRGYT

SEQ ID NO: 100 - DNA, 24 bp, Artificial Sequence
  Description of Artificial Sequence: Synthetic oligonucleotide
attaaccctagccgaggatacacc

SEQ ID NO: 101 - protein, 106 aa, Artificial Sequence [sequence omitted]

SEQ ID NO: 102 - DNA, 318 bp, Artificial Sequence
  Description of Artificial Sequence: Synthetic polynucleotide
cagattgtgctgacacagtctccagctatcatgtccgcatctcccggcgagaaagtcactatgacctgctccgcctcaagctccgtgtcttacatgaattggtatcagcagaaatcaggaaccagccccaagagatggatctacgacacatccaagctggcatctggagtgcctgcacacttcaggggcagtgggtcaggaactagctattccctgaccattagcggcatggaggccgaagatgccgctacctactattgtcagcagtggtctagtaacccattcacatttggcagcgggactaagctggagatcaat

SEQ ID NO: 103 - protein, 5 aa, Artificial Sequence
  Description of Artificial Sequence: Synthetic peptide
SSVSY

SEQ ID NO: 104 - DNA, 15 bp, Artificial Sequence
  Description of Artificial Sequence: Synthetic oligonucleotide
agctccgtgtcttac

SEQ ID NO: 105 - protein, 9 aa, Artificial Sequence
  Description of Artificial Sequence: Synthetic peptide
QQWSSNPFT

SEQ ID NO: 106 - DNA, 27 bp, Artificial Sequence
  Description of Artificial Sequence: Synthetic oligonucleotide
cagcagtggtctagtaacccattcaca

SEQ ID NO: 107 - protein, 3 aa, Artificial Sequence
  Description of Artificial Sequence: Synthetic peptide
DTS

SEQ ID NO: 108 - DNA, 9 bp, Artificial Sequence
  Description of Artificial Sequence: Synthetic oligonucleotide
gacacatcc

SEQ ID NO: 109 - protein, 110 aa, Artificial Sequence; identical to SEQ ID NO: 19
  Description of Artificial Sequence: Synthetic polypeptide

SEQ ID NO: 110 - DNA, 330 bp, Artificial Sequence
  Description of Artificial Sequence: Synthetic polynucleotide
gctccagaagctgcaggaggaccttccgtgttcctgtttccacccaaaccaaaggatacactgatgattagccgcacccctgaggtcacatgcgtggtcgtgagcgtgagccacgaggaccccgaagtcaagttcaactggtacgtggacggcgtcgaagtgcataatgccaaaaccaagcctagggaggaacagtacaacagtacatatagagtcgtgtcagtgctgaccgtcctgcaccaggattggctgaacggcaaggagtacaaatgcaaggtgtccaacaaggcactgcctgccccaatcgagaagaccatttctaaagctaag

SEQ ID NO: 111 - protein, 106 aa, Artificial Sequence; identical to SEQ ID NO: 89
  Description of Artificial Sequence: Synthetic polypeptide

SEQ ID NO: 112 - DNA, 318 bp, Artificial Sequence
  Description of Artificial Sequence: Synthetic polynucleotide
gggcagccccgagaacctcaggtctacgtgtatcctccatcccgggacgagctgactaaaaaccaggtctctctgacctgtctggtgaagggcttttacccatctgatattgcagtcgagtgggaaagtaatgggcagcccgagaacaattataagacaactccccctgtgctggactccgatgggtctttcgcactggtcagcaaactgacagtggataagtccagatggcagcagggaaacgtcttttcttgtagtgtgatgcatgaagccctgcacaatcattacactcagaaatcactgagcctgtcccccggc

SEQ ID NO: 113 - protein, 484 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 114 - DNA, 1452 bp, Artificial Sequence
  Description of Artificial Sequence: Synthetic polynucleotide
gatattcagctgacccagagtcctgcatcactggctgtgagcctgggacagcgagcaacaatctcctgcaaagccagtcagtcagtggactatgatggcgactcctatctgaactggtaccagcagatcccagggcagccccctaagctgctgatctacgacgcttcaaatctggtgagcggcatcccaccacgattcagcggcagcggctctggaaccgattttacactgaacattcacccagtcgagaaggtggacgccgctacctaccattgccagcagtctacagaggacccctggactttcggcgggggaaccaaactggaaatcaagggaggaggaggcagtggcggaggagggtcaggaggaggaggaagccaggtgcagctgcagcagagcggagcagagctggtcagaccaggaagctccgtgaaaatttcctgtaaggcttctggctatgcattttctagttactggatgaattgggtgaagcagaggccaggacagggcctggaatggatcgggcagatttggcccggggatggagacacaaactataatggaaagttcaaaggcaaggccactctgaccgctgacgagtcaagctccactgcttatatgcagctgtctagtctggcaagcgaggattccgccgtctacttttgcgctcggagagaaaccacaactgtgggcaggtactattacgcaatggactactggggccaggggaccacagtcaccgtgtcaagcgcagccgaacccaaatcctctgataagacacacacttgccctccatgtccagcacctgaggctgcaggaggaccaagcgtgttcctgtttccccctaaacctaaggacactctgatgatctctcggactcccgaagtcacctgtgtggtcgtgagcgtgagccacgaggaccctgaagtcaaattcaactggtacgtggatggcgtcgaggtgcataatgccaaaacaaagcctagggaggaacagtataactccacataccgcgtcgtgtctgtcctgactgtgctgcatcaggactggctgaacggaaaggagtacaaatgcaaggtgagcaacaaggcactgccagcccccatcgagaagaccatttccaaagccaagggccagcctcgagaaccacaggtctatgtgctgccacccagccgggacgagctgacaaaaaaccaggtctccctgctgtgtctggtgaagggattctacccttctgatattgctgtggagtgggaaagtaatggccagccagaaaacaattatctgacttggcctccagtgctggattctgacgggagtttctttctgtacagtaaactgaccgtggataagtcacggtggcagcagggaaacgtctttagttgttcagtgatgcacgaggccctgcacaatcattacacccagaaaagcctgtccctgtctcccggcaag

SEQ ID NO: 115 - protein, 111 aa, Artificial Sequence; identical to SEQ ID NO: 59
  Description of Artificial Sequence: Synthetic polypeptide

SEQ ID NO: 116 - DNA, 333 bp, Artificial Sequence
  Description of Artificial Sequence: Synthetic polynucleotide
gatattcagctgacccagagtcctgcatcactggctgtgagcctgggacagcgagcaacaatctcctgcaaagccagtcagtcagtggactatgatggcgactcctatctgaactggtaccagcagatcccagggcagccccctaagctgctgatctacgacgcttcaaatctggtgagcggcatcccaccacgattcagcggcagcggctctggaaccgattttacactgaacattcacccagtcgagaaggtggacgccgctacctaccattgccagcagtctacagaggacccctggactttcggcgggggaaccaaactggaaatcaag

SEQ ID NO: 117 - protein, 10 aa, Artificial Sequence
  Description of Artificial Sequence: Synthetic peptide
QSVDYDGDSY

SEQ ID NO: 118 - DNA, 30 bp, Artificial Sequence; identical to SEQ ID NO: 74
  Description of Artificial Sequence: Synthetic oligonucleotide

SEQ ID NO: 119 - protein, 9 aa, Artificial Sequence
  Description of Artificial Sequence: Synthetic peptide
QQSTEDPWT

SEQ ID NO: 120 - DNA, 27 bp, Artificial Sequence
  Description of Artificial Sequence: Synthetic oligonucleotide
cagcagtctacagaggacccctggact

SEQ ID NO: 121 - protein, 3 aa, Artificial Sequence
  Description of Artificial Sequence: Synthetic peptide
DAS

SEQ ID NO: 122 - DNA, 9 bp, Artificial Sequence
  Description of Artificial Sequence: Synthetic oligonucleotide
gacgcttca

SEQ ID NO: 123 - protein, 124 aa, Artificial Sequence; identical to SEQ ID NO: 79
  Description of Artificial Sequence: Synthetic polypeptide

SEQ ID NO: 124 - DNA, 372 bp, Artificial Sequence
  Description of Artificial Sequence: Synthetic polynucleotide
caggtgcagctgcagcagagcggagcagagctggtcagaccaggaagctccgtgaaaatttcctgtaaggcttctggctatgcattttctagttactggatgaattgggtgaagcagaggccaggacagggcctggaatggatcgggcagatttggcccggggatggagacacaaactataatggaaagttcaaaggcaaggccactctgaccgctgacgagtcaagctccactgcttatatgcagctgtctagtctggcaagcgaggattccgccgtctacttttgcgctcggagagaaaccacaactgtgggcaggtactattacgcaatggactactggggccaggggaccacagtcaccgtgtcaagc

SEQ ID NO: 125 - protein, 8 aa, Artificial Sequence
  Description of Artificial Sequence: Synthetic peptide
GYAFSSYW

SEQ ID NO: 126 - DNA, 24 bp, Artificial Sequence
  Description of Artificial Sequence: Synthetic oligonucleotide
ggctatgcattttctagttactgg

SEQ ID NO: 127 - protein, 17 aa, Artificial Sequence
  Description of Artificial Sequence: Synthetic peptide
ARRETTTVGRYYYAMDY

SEQ ID NO: 128 - DNA, 51 bp, Artificial Sequence
  Description of Artificial Sequence: Synthetic oligonucleotide
gctcggagagaaaccacaactgtgggcaggtactattacgcaatggactac

SEQ ID NO: 129 - protein, 8 aa, Artificial Sequence
  Description of Artificial Sequence: Synthetic peptide
IWPGDGDT

SEQ ID NO: 130 - DNA, 24 bp, Artificial Sequence
  Description of Artificial Sequence: Synthetic oligonucleotide
atttggcccggggatggagacaca

SEQ ID NO: 131 - protein, 110 aa, Artificial Sequence; identical to SEQ ID NO: 19
  Description of Artificial Sequence: Synthetic polypeptide

SEQ ID NO: 132 - DNA, 330 bp, Artificial Sequence
  Description of Artificial Sequence: Synthetic polynucleotide
gcacctgaggctgcaggaggaccaagcgtgttcctgtttccccctaaacctaaggacactctgatgatctctcggactcccgaagtcacctgtgtggtcgtgagcgtgagccacgaggaccctgaagtcaaattcaactggtacgtggatggcgtcgaggtgcataatgccaaaacaaagcctagggaggaacagtataactccacataccgcgtcgtgtctgtcctgactgtgctgcatcaggactggctgaacggaaaggagtacaaatgcaaggtgagcaacaaggcactgccagcccccatcgagaagaccatttccaaagccaag

SEQ ID NO: 133 - protein, 106 aa, Artificial Sequence; identical to SEQ ID NO: 21
  Description of Artificial Sequence: Synthetic polypeptide

SEQ ID NO: 134 - DNA, 318 bp, Artificial Sequence
  Description of Artificial Sequence: Synthetic polynucleotide
ggccagcctcgagaaccacaggtctatgtgctgccacccagccgggacgagctgacaaaaaaccaggtctccctgctgtgtctggtgaagggattctacccttctgatattgctgtggagtgggaaagtaatggccagccagaaaacaattatctgacttggcctccagtgctggattctgacgggagtttctttctgtacagtaaactgaccgtggataagtcacggtggcagcagggaaacgtctttagttgttcagtgatgcacgaggccctgcacaatcattacacccagaaaagcctgtccctgtctcccggc

SEQ ID NO: 135 - protein, 447 aa, Artificial Sequence
  Description of Artificial Sequence: Synthetic polypeptide
QVQLQQPGAELVKPGTSVKLSCKSSGYTFTSYWIHWVKQRPGHGLEWIGEIDPSDNYTYYNQNFKGKATLTIDKSSSTAYMQLNSLTSEDSAVFYCARSGYGNLFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 136 - DNA, 1341 bp, Artificial Sequence
  Description of Artificial Sequence: Synthetic polynucleotide
caggtccagctgcagcagcctggggcagaactggtcaaacctggcacttccgtgaaactgtcatgtaaatcctctggctatacttttacatcctactggattcactgggtgaagcagcgaccaggacatggactggagtggatcggagaaattgaccctagtgataactacacctactacaaccagaatttcaagggcaaagcaaccctgacaattgacaaaagctcctctactgcctacatgcagctgaatagtctgacctcagaggatagcgccgtcttttattgcgctagaagcggatacggcaatctgttcgtctattggggccagggaaccctggtcaccgtctctgctgctagcactaaggggccttccgtgtttccactggctccctctagtaaatccacctctggaggcacagctgcactgggatgtctggtgaaggattacttccctgaaccagtcacagtgagttggaactcaggggctctgacaagtggagtccatacttttcccgcagtgctgcagtcaagcggactgtactccctgtcctctgtggtcaccgtgcctagttcaagcctgggcacccagacatatatctgcaacgtgaatcacaagccatcaaatacaaaagtcgacaagaaagtggagcccaagagctgtgataaaactcatacctgcccaccttgtccggcgccagaactgctgggaggaccaagcgtgttcctgtttccacccaagcctaaagacaccctgatgatttcccggactcctgaggtcacctgcgtggtcgtggacgtgtctcacgaggaccccgaagtcaagttcaactggtacgtggatggcgtcgaagtgcataatgccaagaccaaaccccgggaggaacagtacaactctacctatagagtcgtgagtgtcctgacagtgctgcaccaggactggctgaatgggaaggagtataagtgtaaagtgagcaacaaagccctgcccgccccaatcgaaaaaacaatctctaaagcaaaaggacagcctcgcgaaccacaggtctacgtgctgccccctagccgcgacgaactgactaaaaatcaggtctctctgctgtgtctggtcaaaggattctacccttccgacatcgccgtggagtgggaaagtaacggccagcccgagaacaattacctgacctggccccctgtgctggactctgatgggagtttctttctgtattcaaagctgacagtcgataaaagccggtggcagcagggcaatgtgttcagctgctccgtcatgcacgaagcactgcacaaccattacactcagaagtccctgtccctgtcacctggc

SEQ ID NO: 137 - protein, 118 aa, Artificial Sequence
  Description of Artificial Sequence: Synthetic polypeptide
QVQLQQPGAELVKPGTSVKLSCKSSGYTFTSYWIHWVKQRPGHGLEWIGEIDPSDNYTYYNQNFKGKATLTIDKSSSTAYMQLNSLTSEDSAVFYCARSGYGNLFVYWGQGTLVTVSA

SEQ ID NO: 138 - DNA, 354 bp, Artificial Sequence
  Description of Artificial Sequence: Synthetic polynucleotide
caggtccagctgcagcagcctggggcagaactggtcaaacctggcacttccgtgaaactgtcatgtaaatcctctggctatacttttacatcctactggattcactgggtgaagcagcgaccaggacatggactggagtggatcggagaaattgaccctagtgataactacacctactacaaccagaatttcaagggcaaagcaaccctgacaattgacaaaagctcctctactgcctacatgcagctgaatagtctgacctcagaggatagcgccgtcttttattgcgctagaagcggatacggcaatctgttcgtctattggggccagggaaccctggtcaccgtctctgct

SEQ ID NO: 139 - protein, 11 aa, Artificial Sequence
  Description of Artificial Sequence: Synthetic peptide
KSSGYTFTSYW

SEQ ID NO: 140 - DNA, 33 bp, Artificial Sequence
  Description of Artificial Sequence: Synthetic oligonucleotide
aaatcctctggctatacttttacatcctactgg

SEQ ID NO: 141 - protein, 11 aa, Artificial Sequence
  Description of Artificial Sequence: Synthetic peptide
ARSGYGNLFVY

SEQ ID NO: 142 - DNA, 33 bp, Artificial Sequence
  Description of Artificial Sequence: Synthetic oligonucleotide
gctagaagcggatacggcaatctgttcgtctat

SEQ ID NO: 143 - protein, 8 aa, Artificial Sequence
  Description of Artificial Sequence: Synthetic peptide
IDPSDNYT

SEQ ID NO: 144 - DNA, 24 bp, Artificial Sequence
  Description of Artificial Sequence: Synthetic oligonucleotide
attgaccctagtgataactacacc

SEQ ID NO: 145 - protein, 98 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 146 - DNA, 294 bp, Artificial Sequence
  Description of Artificial Sequence: Synthetic polynucleotide
gctagcactaaggggccttccgtgtttccactggctccctctagtaaatccacctctggaggcacagctgcactgggatgtctggtgaaggattacttccctgaaccagtcacagtgagttggaactcaggggctctgacaagtggagtccatacttttcccgcagtgctgcagtcaagcggactgtactccctgtcctctgtggtcaccgtgcctagttcaagcctgggcacccagacatatatctgcaacgtgaatcacaagccatcaaatacaaaagtcgacaagaaagtg

SEQ ID NO: 147 - protein, 110 aa, Artificial Sequence
  Description of Artificial Sequence: Synthetic polypeptide
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 148 - DNA, 330 bp, Artificial Sequence
  Description of Artificial Sequence: Synthetic polynucleotide
gcgccagaactgctgggaggaccaagcgtgttcctgtttccacccaagcctaaagacaccctgatgatttcccggactcctgaggtcacctgcgtggtcgtggacgtgtctcacgaggaccccgaagtcaagttcaactggtacgtggatggcgtcgaagtgcataatgccaagaccaaaccccgggaggaacagtacaactctacctatagagtcgtgagtgtcctgacagtgctgcaccaggactggctgaatgggaaggagtataagtgtaaagtgagcaacaaagccctgcccgccccaatcgaaaaaacaatctctaaagcaaaa

SEQ ID NO: 149 - protein, 106 aa, Artificial Sequence; identical to SEQ ID NO: 21
  Description of Artificial Sequence: Synthetic polypeptide

SEQ ID NO: 150 - DNA, 318 bp, Artificial Sequence
  Description of Artificial Sequence: Synthetic polynucleotide
ggacagcctcgcgaaccacaggtctacgtgctgccccctagccgcgacgaactgactaaaaatcaggtctctctgctgtgtctggtcaaaggattctacccttccgacatcgccgtggagtgggaaagtaacggccagcccgagaacaattacctgacctggccccctgtgctggactctgatgggagtttctttctgtattcaaagctgacagtcgataaaagccggtggcagcagggcaatgtgttcagctgctccgtcatgcacgaagcactgcacaaccattacactcagaagtccctgtccctgtcacctggc

SEQ ID NO: 151 - protein, 450 aa, Artificial Sequence
  Description of Artificial Sequence: Synthetic polypeptide
QVTLRESGPALVKPTQTLTLTCTFSGFSLSTSGMGVGWIRQPPGKALEWLAHIWWDDDKRYNPALKSRLTISKDTSKNQVVLTMTNMDPVDTAAYYCARMELWSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 152 - DNA, 1350 bp, Artificial Sequence
  Description of Artificial Sequence: Synthetic polynucleotide
caggtgacactgagagaatccggcccagccctggtgaagcccactcagaccctgacactgacttgcaccttctctgggttttccctgtctacaagtgggatgggagtgggatggatcaggcagccacctggaaaagccctggagtggctggctcacatttggtgggacgatgacaagcggtacaacccagcactgaaaagcagactgacaatcagcaaggatacttccaaaaaccaggtggtcctgacaatgactaatatggaccccgtggacacagccgcttactattgcgcccgcatggaactgtggagctactatttcgactactgggggcagggaacactggtcactgtgagctccgcttctactaagggacccagtgtgtttcctctggcaccatctagtaaatcaaccagcggaggaacagcagcactgggatgtctggtgaaggattatttccctgagccagtcaccgtgtcctggaactctggcgcactgaccagcggggtccatacatttcccgccgtgctgcagtcaagcgggctgtacagcctgtcctctgtggtcaccgtgcctagttcaagcctgggaacccagacatatatctgcaacgtgaatcacaagccctctaatacaaaagtcgataagaaagtggaacctaagagttgtgacaaaactcatacctgcccaccatgtccagcacctgagctgctgggaggcccttccgtgttcctgtttcctccaaagccaaaagatacactgatgattagccgaactcctgaagtgacctgcgtggtcgtggatgtgagccacgaggacccagaagtcaagttcaactggtacgtggacggcgtcgaggtgcataatgctaagaccaaacctagggaggaacagtacaattcaacatatcgcgtcgtgagcgtcctgactgtgctgcaccaggattggctgaacgggaaggagtataagtgcaaagtgtccaataaggctctgccagcacccatcgagaaaaccatttctaaggctaaaggccagccccgagaacctcaggtctacgtgtatccccctagccgggatgagctgactaagaaccaggtctccctgacctgtctggtgaaaggattttacccaagtgacattgcagtggagtgggaatcaaatggccagcccgaaaacaattataagaccacaccacccgtgctggatagtgacggctcattcgccctggtctccaagctgactgtggacaaatctaggtggcagcaggggaacgtcttttcctgttctgtgatgcatgaggctctgcacaatcattacacccagaagagtctgtcactgagccccggcaaa

SEQ ID NO: 153 - protein, 120 aa, Artificial Sequence
  Description of Artificial Sequence: Synthetic polypeptide
QVTLRESGPALVKPTQTLTLTCTFSGFSLSTSGMGVGWIRQPPGKALEWLAHIWWDDDKRYNPALKSRLTISKDTSKNQVVLTMTNMDPVDTAAYYCARMELWSYYFDYWGQGTLVTVSS

SEQ ID NO: 154 - DNA, 360 bp, Artificial Sequence
  Description of Artificial Sequence: Synthetic polynucleotide
caggtgacactgagagaatccggcccagccctggtgaagcccactcagaccctgacactgacttgcaccttctctgggttttccctgtctacaagtgggatgggagtgggatggatcaggcagccacctggaaaagccctggagtggctggctcacatttggtgggacgatgacaagcggtacaacccagcactgaaaagcagactgacaatcagcaaggatacttccaaaaaccaggtggtcctgacaatgactaatatggaccccgtggacacagccgcttactattgcgcccgcatggaactgtggagctactatttcgactactgggggcagggaacactggtcactgtgagctcc

SEQ ID NO: 155 - protein, 10 aa, Artificial Sequence
  Description of Artificial Sequence: Synthetic peptide
GFSLSTSGMG

SEQ ID NO: 156 - DNA, 30 bp, Artificial Sequence
  Description of Artificial Sequence: Synthetic oligonucleotide
gggttttccctgtctacaagtgggatggga

SEQ ID NO: 157 - protein, 12 aa, Artificial Sequence
  Description of Artificial Sequence: Synthetic peptide
ARMELWSYYFDY

SEQ ID NO: 158 - DNA, 36 bp, Artificial Sequence
  Description of Artificial Sequence: Synthetic oligonucleotide
gcccgcatggaactgtggagctactatttcgactac

SEQ ID NO: 159 - protein, 7 aa, Artificial Sequence
  Description of Artificial Sequence: Synthetic peptide
IWWDDDK

SEQ ID NO: 160 - DNA, 21 bp, Artificial Sequence
  Description of Artificial Sequence: Synthetic oligonucleotide
atttggtgggacgatgacaag

SEQ ID NO: 161 - protein, 98 aa, Artificial Sequence; identical to SEQ ID NO: 145
  Description of Artificial Sequence: Synthetic polypeptide

SEQ ID NO: 162 - DNA, 294 bp, Artificial Sequence
  Description of Artificial Sequence: Synthetic polynucleotide
gcttctactaagggacccagtgtgtttcctctggcaccatctagtaaatcaaccagcggaggaacagcagcactgggatgtctggtgaaggattatttccctgagccagtcaccgtgtcctggaactctggcgcactgaccagcggggtccatacatttcccgccgtgctgcagtcaagcgggctgtacagcctgtcctctgtggtcaccgtgcctagttcaagcctgggaacccagacatatatctgcaacgtgaatcacaagccctctaatacaaaagtcgataagaaagtg

SEQ ID NO: 163 - protein, 110 aa, Artificial Sequence; identical to SEQ ID NO: 147
  Description of Artificial Sequence: Synthetic polypeptide

SEQ ID NO: 164 - DNA, 330 bp, Artificial Sequence
  Description of Artificial Sequence: Synthetic polynucleotide
gcacctgagctgctgggaggcccttccgtgttcctgtttcctccaaagccaaaagatacactgatgattagccgaactcctgaagtgacctgcgtggtcgtggatgtgagccacgaggacccagaagtcaagttcaactggtacgtggacggcgtcgaggtgcataatgctaagaccaaacctagggaggaacagtacaattcaacatatcgcgtcgtgagcgtcctgactgtgctgcaccaggattggctgaacgggaaggagtataagtgcaaagtgtccaataaggctctgccagcacccatcgagaaaaccatttctaaggctaaa

SEQ ID NO: 165 - protein, 106 aa, Artificial Sequence; identical to SEQ ID NO: 89
  Description of Artificial Sequence: Synthetic polypeptide

SEQ ID NO: 166 - DNA, 318 bp, Artificial Sequence
  Description of Artificial Sequence: Synthetic polynucleotide
ggccagccccgagaacctcaggtctacgtgtatccccctagccgggatgagctgactaagaaccaggtctccctgacctgtctggtgaaaggattttacccaagtgacattgcagtggagtgggaatcaaatggccagcccgaaaacaattataagaccacaccacccgtgctggatagtgacggctcattcgccctggtctccaagctgactgtggacaaatctaggtggcagcaggggaacgtcttttcctgttctgtgatgcatgaggctctgcacaatcattacacccagaagagtctgtcactgagccccggc

SEQ ID NO: 167 - protein, 450 aa, Artificial Sequence
  Description of Artificial Sequence: Synthetic polypeptide
QVTLRESGPALVKPTQTLTLTCTFSGFSLSTSGMGVGWIRQPPGKALEWLAHIWWDDDKRYNPALKSRLTISKDTSKNQVVLTMTNMDPVDTAAYYCARMELWSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 168 - DNA, 1350 bp, Artificial Sequence
  Description of Artificial Sequence: Synthetic polynucleotide
caggtgacactgagagaatccggaccagcactggtgaagccaacccagacactgactctgacctgcacattctctgggttttccctgtctacaagtgggatgggagtgggatggatcaggcagccacctggaaaggcactggagtggctggctcacatttggtgggacgatgacaagcggtacaacccagccctgaaaagcagactgactatcagcaaggatacctccaaaaaccaggtggtcctgactatgaccaatatggaccccgtggacactgccgcttactattgcgctcgcatggaactgtggagctactatttcgactactgggggcagggaactctggtcaccgtgagctccgcttctaccaagggacccagtgtgtttcctctggcaccatctagtaaatcaacaagcggaggaactgcagcactgggatgtctggtgaaggattatttccctgagccagtcaccgtgtcctggaactctggcgcactgacaagcggggtccatacttttcccgccgtgctgcagtcaagcgggctgtacagcctgtcctctgtggtcacagtgcctagttcaagcctgggaacacagacttatatctgcaacgtgaatcacaagccctctaatactaaagtcgataagaaagtggaacctaagagttgtgacaaaacccatacatgcccaccatgtccagctcctgagctgctgggaggaccttccgtgttcctgtttcctccaaagccaaaagatacactgatgattagccgaacccctgaagtcacatgcgtggtcgtggatgtgagccacgaggacccagaagtcaagttcaactggtacgtggacggcgtcgaggtgcataatgccaagaccaaacctagggaggaacagtacaattcaacctatcgcgtcgtgagcgtcctgacagtgctgcaccaggattggctgaacgggaaggagtataagtgcaaagtgtccaataaggctctgccagcacccatcgagaaaaccatttctaaggcaaaaggccagccccgagaacctcaggtctacgtgctgccccctagccgggatgagctgacaaagaaccaggtctccctgctgtgtctggtgaaaggattctatccaagtgacattgccgtggagtgggaatcaaatggccagcccgaaaacaattacctgacttggccacccgtgctggatagtgacggctcattctttctgtattccaagctgaccgtggacaaatctaggtggcagcaggggaacgtcttttcctgttctgtgatgcatgaggccctgcacaatcattacacccagaagagtctgtcactgagccccggcaaa

SEQ ID NO: 169 - protein, 120 aa, Artificial Sequence; identical to SEQ ID NO: 153
  Description of Artificial Sequence: Synthetic polypeptide

SEQ ID NO: 170 - DNA, 360 bp, Artificial Sequence
  Description of Artificial Sequence: Synthetic polynucleotide
caggtgacactgagagaatccggaccagcactggtgaagccaacccagacactgactctgacctgcacattctctgggttttccctgtctacaagtgggatgggagtgggatggatcaggcagccacctggaaaggcactggagtggctggctcacatttggtgggacgatgacaagcggtacaacccagccctgaaaagcagactgactatcagcaaggatacctccaaaaaccaggtggtcctgactatgaccaatatggaccccgtggacactgccgcttactattgcgctcgcatggaactgtggagctactatttcgactactgggggcagggaactctggtcaccgtgagctcc

SEQ ID NO: 171 - protein, 10 aa, Artificial Sequence
  Description of Artificial Sequence: Synthetic peptide
GFSLSTSGMG

SEQ ID NO: 172 - DNA, 30 bp, Artificial Sequence; identical to SEQ ID NO: 156
  Description of Artificial Sequence: Synthetic oligonucleotide

SEQ ID NO: 173 - protein, 12 aa, Artificial Sequence
  Description of Artificial Sequence: Synthetic peptide
ARMELWSYYFDY

SEQ ID NO: 174 - DNA, 36 bp, Artificial Sequence
  Description of Artificial Sequence: Synthetic oligonucleotide
gctcgcatggaactgtggagctactatttcgactac

SEQ ID NO: 175 - protein, 7 aa, Artificial Sequence
  Description of Artificial Sequence: Synthetic peptide
IWWDDDK

SEQ ID NO: 176 - DNA, 21 bp, Artificial Sequence
  Description of Artificial Sequence: Synthetic oligonucleotide
atttggtgggacgatgacaag

SEQ ID NO: 177 - protein, 98 aa, Artificial Sequence; identical to SEQ ID NO: 145
  Description of Artificial Sequence: Synthetic polypeptide

SEQ ID NO: 178 - DNA, 294 bp, Artificial Sequence
  Description of Artificial Sequence: Synthetic polynucleotide
gcttctaccaagggacccagtgtgtttcctctggcaccatctagtaaatcaacaagcggaggaactgcagcactgggatgtctggtgaaggattatttccctgagccagtcaccgtgtcctggaactctggcgcactgacaagcggggtccatacttttcccgccgtgctgcagtcaagcgggctgtacagcctgtcctctgtggtcacagtgcctagttcaagcctgggaacacagacttatatctgcaacgtgaatcacaagccctctaatactaaagtcgataagaaagtg

SEQ ID NO: 179 - protein, 110 aa, Artificial Sequence; identical to SEQ ID NO: 147
  Description of Artificial Sequence: Synthetic polypeptide

SEQ ID NO: 180 - DNA, 330 bp, Artificial Sequence
  Description of Artificial Sequence: Synthetic polynucleotide
gctcctgagctgctgggaggaccttccgtgttcctgtttcctccaaagccaaaagatacactgatgattagccgaacccctgaagtcacatgcgtggtcgtggatgtgagccacgaggacccagaagtcaagttcaactggtacgtggacggcgtcgaggtgcataatgccaagaccaaacctagggaggaacagtacaattcaacctatcgcgtcgtgagcgtcctgacagtgctgcaccaggattggctgaacgggaaggagtataagtgcaaagtgtccaataaggctctgccagcacccatcgagaaaaccatttctaaggcaaaa

SEQ ID NO: 181 - protein, 106 aa, Artificial Sequence; identical to SEQ ID NO: 21
  Description of Artificial Sequence: Synthetic polypeptide

SEQ ID NO: 182 - DNA, 318 bp, Artificial Sequence
  Description of Artificial Sequence: Synthetic polynucleotide
ggccagccccgagaacctcaggtctacgtgctgccccctagccgggatgagctgacaaagaaccaggtctccctgctgtgtctggtgaaaggattctatccaagtgacattgccgtggagtgggaatcaaatggccagcccgaaaacaattacctgacttggccacccgtgctggatagtgacggctcattctttctgtattccaagctgaccgtggacaaatctaggtggcagcaggggaacgtcttttcctgttctgtgatgcatgaggccctgcacaatcattacacccagaagagtctgtcactgagccccggc

SEQ ID NO: 183 - protein, 213 aa, Artificial Sequence
  Description of Artificial Sequence: Synthetic polypeptide
EIVLTQSPATLSLSPGERATLSCSASSSVSYMHWYQQKPGQAPRLLIYDTSKLASGIPARFSGSGSGTDFTLTISSLEPEDFAVYYCFQGSVYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - DNA, 639 bp, Artificial Sequence
  Description of Artificial Sequence: Synthetic polynucleotide
gaaatcgtcctgacacagagtcctgctactctgtcactgagcccaggcgagcgagctaccctgtcctgctctgcaagctcctctgtgtcctacatgcactggtatcagcagaagccaggacaggcaccacgactgctgatctacgacacctctaaactggcaagtggcatccccgccagattcagtggctcagggagcggaacagactttaccctgacaatcagttcactggagcccgaagatttcgccgtgtactattgctttcagggcagcgtctatcctttcacctttggccaggggacaaagctggagatcaaaaggactgtggccgctccatccgtcttcatttttcccccttctgacgaacagctgaagtcaggcacagctagcgtggtctgtctgctgaacaatttctacccccgcgaggccaaggtgcagtggaaagtcgataacgctctgcagtccggcaacagccaggagagtgtgactgaacaggactcaaaggatagcacctattccctgagctccactctgaccctgtctaaagcagattacgagaagcacaaagtgtatgcctgcgaagtcacacatcagggactgtctagtcccgtgactaaatcctttaacagaggcgaatgt

SEQ ID NO: 185 - protein, 106 aa, Artificial Sequence
  Description of Artificial Sequence: Synthetic polypeptide
EIVLTQSPATLSLSPGERATLSCSASSSVSYMHWYQQKPGQAPRLLIYDTSKLASGIPARFSGSGSGTDFTLTISSLEPEDFAVYYCFQGSVYPFTFGQGTKLEIK

SEQ ID NO: 186 - DNA, 318 bp, Artificial Sequence
  Description of Artificial Sequence: Synthetic polynucleotide
gaaatcgtcctgacacagagtcctgctactctgtcactgagcccaggcgagcgagctaccctgtcctgctctgcaagctcctctgtgtcctacatgcactggtatcagcagaagccaggacaggcaccacgactgctgatctacgacacctctaaactggcaagtggcatccccgccagattcagtggctcagggagcggaacagactttaccctgacaatcagttcactggagcccgaagatttcgccgtgtactattgctttcagggcagcgtctatcctttcacctttggccaggggacaaagctggagatcaaa

SEQ ID NO: 187 - protein, 5 aa, Artificial Sequence
  Description of Artificial Sequence: Synthetic peptide
SSVSY

SEQ ID NO: 188 - DNA, 15 bp, Artificial Sequence
  Description of Artificial Sequence: Synthetic oligonucleotide
tcctctgtgtcctac

SEQ ID NO: 189 - protein, 9 aa, Artificial Sequence
  Description of Artificial Sequence: Synthetic peptide
FQGSVYPFT

SEQ ID NO: 190 - DNA, 27 bp, Artificial Sequence
  Description of Artificial Sequence: Synthetic oligonucleotide
tttcagggcagcgtctatcctttcacc

SEQ ID NO: 191 - protein, 3 aa, Artificial Sequence
  Description of Artificial Sequence: Synthetic peptide
DTS

SEQ ID NO: 192 - DNA, 9 bp, Artificial Sequence
  Description of Artificial Sequence: Synthetic oligonucleotide
gacacctct

SEQ ID NO: 193 - protein, 107 aa, Artificial Sequence [sequence omitted]

SEQ ID NO: 194 - DNA, 321 bp, Artificial Sequence
  Description of Artificial Sequence: Synthetic polynucleotide
aggactgtggccgctccatccgtcttcatttttcccccttctgacgaacagctgaagtcaggcacagctagcgtggtctgtctgctgaacaatttctacccccgcgaggccaaggtgcagtggaaagtcgataacgctctgcagtccggcaacagccaggagagtgtgactgaacaggactcaaaggatagcacctattccctgagctccactctgaccctgtctaaagcagattacgagaagcacaaagtgtatgcctgcgaagtcacacatcagggactgtctagtcccgtgactaaatcctttaacagaggcgaatgt

SEQ ID NO: 195 - protein, 450 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 196 - DNA, 1350 bp, Artificial Sequence
  Description of Artificial Sequence: Synthetic polynucleotide
gaggtgcagctggtggaaagcggaggaggactggtgcagccaggaggatctctgcgactgagttgcgccgcttcaggattcaacatcaaggacacctacattcactgggtgcgacaggctccaggaaaaggactggagtgggtggctcgaatctatcccactaatggatacacccggtatgccgactccgtgaaggggaggtttactattagcgccgatacatccaaaaacactgcttacctgcagatgaacagcctgcgagccgaagataccgctgtgtactattgcagtcgatggggaggagacggattctacgctatggattattggggacaggggaccctggtgacagtgagctccgcctctaccaagggccccagtgtgtttcccctggctccttctagtaaatccacctctggagggacagccgctctgggatgtctggtgaaggactatttccccgagcctgtgaccgtgagttggaactcaggcgccctgacaagcggagtgcacacttttcctgctgtgctgcagtcaagcgggctgtactccctgtcctctgtggtgacagtgccaagttcaagcctgggcacacagacttatatctgcaacgtgaatcataagccctcaaatacaaaagtggacaagaaagtggagcccaagagctgtgataagacccacacctgccctccctgtccagctccagaactgctgggaggacctagcgtgttcctgtttccccctaagccaaaagacactctgatgatttccaggactcccgaggtgacctgcgtggtggtggacgtgtctcacgaggaccccgaagtgaagttcaactggtacgtggatggcgtggaagtgcataatgctaagacaaaaccaagagaggaacagtacaactccacttatcgcgtcgtgagcgtgctgaccgtgctgcaccaggactggctgaacgggaaggagtataagtgcaaagtcagtaataaggccctgcctgctccaatcgaaaaaaccatctctaaggccaaaggccagccaagggagccccaggtgtacgtgctgccacccagcagagacgaactgaccaagaaccaggtgtccctgctgtgtctggtgaaaggcttctatcctagtgatattgctgtggagtgggaatcaaatggacagccagagaacaattacctgacctggcctccagtgctggacagcgatggcagcttcttcctgtattccaagctgacagtggataaatctcgatggcagcaggggaacgtgtttagttgttcagtgatgcatgaagccctgcacaatcattacactcagaagagcctgtccctgtctcccggcaaa

SEQ ID NO: 197 - protein, 120 aa, Artificial Sequence [sequence omitted]

SEQ ID NO: 198 - DNA, 360 bp, Artificial Sequence
  Description of Artificial Sequence: Synthetic polynucleotide
gaggtgcagctggtggaaagcggaggaggactggtgcagccaggaggatctctgcgactgagttgcgccgcttcaggattcaacatcaaggacacctacattcactgggtgcgacaggctccaggaaaaggactggagtgggtggctcgaatctatcccactaatggatacacccggtatgccgactccgtgaaggggaggtttactattagcgccgatacatccaaaaacactgcttacctgcagatgaacagcctgcgagccgaagataccgctgtgtactattgcagtcgatggggaggagacggattctacgctatggattattggggacaggggaccctggtgacagtgagctcc

SEQ ID NO: 199 - protein, 8 aa, Artificial Sequence
  Description of Artificial Sequence: Synthetic peptide
GFNIKDTY

SEQ ID NO: 200 - DNA, 24 bp, Artificial Sequence
  Description of Artificial Sequence: Synthetic oligonucleotide
ggattcaacatcaaggacacctac

SEQ ID NO: 201 - protein, 13 aa, Artificial Sequence
  Description of Artificial Sequence: Synthetic peptide
SRWGGDGFYAMDY

SEQ ID NO: 202 - DNA, 39 bp, Artificial Sequence
  Description of Artificial Sequence: Synthetic oligonucleotide
agtcgatggggaggagacggattctacgctatggattat

SEQ ID NO: 203 - protein, 8 aa, Artificial Sequence
  Description of Artificial Sequence: Synthetic peptide
IYPTNGYT

SEQ ID NO: 204 - DNA, 24 bp, Artificial Sequence
  Description of Artificial Sequence: Synthetic oligonucleotide
atctatcccactaatggatacacc

SEQ ID NO: 205 - protein, 98 aa, Artificial Sequence; identical to SEQ ID NO: 145
  Description of Artificial Sequence: Synthetic polypeptide

SEQ ID NO: 206 - DNA, 294 bp, Artificial Sequence
  Description of Artificial Sequence: Synthetic polynucleotide
gcctctaccaagggccccagtgtgtttcccctggctccttctagtaaatccacctctggagggacagccgctctgggatgtctggtgaaggactatttccccgagcctgtgaccgtgagttggaactcaggcgccctgacaagcggagtgcacacttttcctgctgtgctgcagtcaagcgggctgtactccctgtcctctgtggtgacagtgccaagttcaagcctgggcacacagacttatatctgcaacgtgaatcataagccctcaaatacaaaagtggacaagaaagtg

SEQ ID NO: 207 - protein, 110 aa, Artificial Sequence; identical to SEQ ID NO: 147
  Description of Artificial Sequence: Synthetic polypeptide

SEQ ID NO: 208 - DNA, 330 bp, Artificial Sequence
  Description of Artificial Sequence: Synthetic polynucleotide
gctccagaactgctgggaggacctagcgtgttcctgtttccccctaagccaaaagacactctgatgatttccaggactcccgaggtgacctgcgtggtggtggacgtgtctcacgaggaccccgaagtgaagttcaactggtacgtggatggcgtggaagtgcataatgctaagacaaaaccaagagaggaacagtacaactccacttatcgcgtcgtgagcgtgctgaccgtgctgcaccaggactggctgaacgggaaggagtataagtgcaaagtcagtaataaggccctgcctgctccaatcgaaaaaaccatctctaaggccaaa

SEQ ID NO: 209 - protein, 106 aa, Artificial Sequence; identical to SEQ ID NO: 21
  Description of Artificial Sequence: Synthetic polypeptide

SEQ ID NO: 210 - DNA, 318 bp, Artificial Sequence
  Description of Artificial Sequence: Synthetic polynucleotide
ggccagccaagggagccccaggtgtacgtgctgccacccagcagagacgaactgaccaagaaccaggtgtccctgctgtgtctggtgaaaggcttctatcctagtgatattgctgtggagtgggaatcaaatggacagccagagaacaattacctgacctggcctccagtgctggacagcgatggcagcttcttcctgtattccaagctgacagtggataaatctcgatggcagcaggggaacgtgtttagttgttcagtgatgcatgaagccctgcacaatcattacactcagaagagcctgtccctgtctcccggc

SEQ ID NO: 211 - protein, 476 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYYDDHYSLDYWGQGTLVTVSSVEGGSGGSGGSGGSGGVDDIQMTQSPSSLSASVGDRVTITCSASSSVSYMNWYQQKPGKAPKRLIYDTSKLASGVPSRFSGSGSGTDYTLTISSLQPEDAATYYCQQWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 212 - DNA, 1428 bp, Artificial Sequence
  Description of Artificial Sequence: Synthetic polynucleotide
caggtgcagctggtgcagagcggaggaggagtggtgcagccaggccggtccctgagactgtcttgtaaggccagcggctacaccttcacaaggtataccatgcactgggtgcgccaggcaccaggcaagggactggagtggatcggctacatcaaccctagcaggggctacacaaactataatcagaaggtgaagggccgcttcaccatctccacagacaactctaagaataccgcctacctgcagatggactccctgagggccgaggatacaggcgtgtatttttgcgcccgctactatgacgatcactacagcctggattattggggccagggcaccctggtgacagtgagctccgtggagggaggctccggaggctctggaggcagcggcggctccggcggcgtggacgatatccagatgacccagagcccttctagcctgtccgcctctgtgggcgacagggtgaccatcacatgtagcgcctcctctagcgtgtcctacatgaactggtatcagcagaagccaggcaaggcccccaagcggctgatctacgataccagcaagctggcctccggcgtgccatctagattcagcggctccggctctggcaccgactataccctgacaatctcctctctgcagcccgaggatgccgccacatactattgccagcagtggagctccaatcctttcacctttggccagggcacaaagctggagatcaaggccgccgagcccaagtctagcgacaagacccacacatgcccaccttgtccggcgccagaggcagcaggaggaccttccgtgttcctgtttccacccaagccaaaggataccctgatgatcagccgcacccctgaggtgacatgcgtggtggtgagcgtgtcccacgaggacccagaggtgaagtttaactggtacgtggatggcgtggaggtgcacaatgccaagacaaagcctcgggaggagcagtacaattctacctatagagtggtgagcgtgctgacagtgctgcaccaggactggctgaacggcaaggagtataagtgcaaggtgtccaataaggccctgcctgccccaatcgagaagaccatctctaaggccaagggccagcctcgcgaacctcaggtgtacgtgctgcctccatctagagacgagctgacaaagaaccaggtgagcctgctgtgcctggtgaagggcttctatccaagcgatatcgccgtggagtgggagtccaatggccagcccgagaacaattacctgacctggccccctgtgctggactctgatggcagcttctttctgtattccaagctgacagtggataagtctaggtggcagcagggcaacgtgttttcttgcagcgtgatgcacgaggccctgcacaatcactacacccagaagtccctgtctctgagccccggc

SEQ ID NO: 213 - protein, 119 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYYDDHYSLDYWGQGTLVTVSS

SEQ ID NO: 214 - DNA, 357 bp, Artificial Sequence
  Description of Artificial Sequence: Synthetic polynucleotide
caggtgcagctggtgcagagcggaggaggagtggtgcagccaggccggtccctgagactgtcttgtaaggccagcggctacaccttcacaaggtataccatgcactgggtgcgccaggcaccaggcaagggactggagtggatcggctacatcaaccctagcaggggctacacaaactataatcagaaggtgaagggccgcttcaccatctccacagacaactctaagaataccgcctacctgcagatggactccctgagggccgaggatacaggcgtgtatttttgcgcccgctactatgacgatcactacagcctggattattggggccagggcaccctggtgacagtgagctcc

SEQ ID NO: 215 - protein, 8 aa, Artificial Sequence
  Description of Artificial Sequence: Synthetic peptide
GYTFTRYT

SEQ ID NO: 216 - DNA, 24 bp, Artificial Sequence
  Description of Artificial Sequence: Synthetic oligonucleotide
ggctacaccttcacaaggtatacc

SEQ ID NO: 217 - protein, 12 aa, Artificial Sequence
  Description of Artificial Sequence: Synthetic peptide
ARYYDDHYSLDY

SEQ ID NO: 218 - DNA, 36 bp, Artificial Sequence
  Description of Artificial Sequence: Synthetic oligonucleotide
gcccgctactatgacgatcactacagcctggattat

SEQ ID NO: 219 - protein, 8 aa, Artificial Sequence
  Description of Artificial Sequence: Synthetic peptide
INPSRGYT

SEQ ID NO: 220 - DNA, 24 bp, Artificial Sequence
  Description of Artificial Sequence: Synthetic oligonucleotide
atcaaccctagcaggggctacaca

SEQ ID NO: 221 - protein, 106 aa, Artificial Sequence
  Description of Artificial Sequence: Synthetic polypeptide
DIQMTQSPSSLSASVGDRVTITCSASSSVSYMNWYQQKPGKAPKRLIYDTSKLASGVPSRFSGSGSGTDYTLTISSLQPEDAATYYCQQWSSNPFTFGQGTKLEIK

SEQ ID NO: 222 - DNA, 318 bp, Artificial Sequence
  Description of Artificial Sequence: Synthetic polynucleotide
gatatccagatgacccagagcccttctagcctgtccgcctctgtgggcgacagggtgaccatcacatgtagcgcctcctctagcgtgtcctacatgaactggtatcagcagaagccaggcaaggcccccaagcggctgatctacgataccagcaagctggcctccggcgtgccatctagattcagcggctccggctctggcaccgactataccctgacaatctcctctctgcagcccgaggatgccgccacatactattgccagcagtggagctccaatcctttcacctttggccagggcacaaagctggagatcaag

SEQ ID NO: 223 - protein, 5 aa, Artificial Sequence
  Description of Artificial Sequence: Synthetic peptide
SSVSY

SEQ ID NO: 224 - DNA, 15 bp, Artificial Sequence
  Description of Artificial Sequence: Synthetic oligonucleotide
tctagcgtgtcctac

SEQ ID NO: 225 - protein, 9 aa, Artificial Sequence
  Description of Artificial Sequence: Synthetic peptide
QQWSSNPFT

SEQ ID NO: 226 - DNA, 27 bp, Artificial Sequence
  Description of Artificial Sequence: Synthetic oligonucleotide
cagcagtggagctccaatcctttcacc

SEQ ID NO: 227 - protein, 3 aa, Artificial Sequence
  Description of Artificial Sequence: Synthetic peptide
DTS

SEQ ID NO: 228 - DNA, 9 bp, Artificial Sequence
  Description of Artificial Sequence: Synthetic oligonucleotide
gataccagc

SEQ ID NO: 229 - protein, 110 aa, Artificial Sequence; identical to SEQ ID NO: 19
  Description of Artificial Sequence: Synthetic polypeptide

SEQ ID NO: 230 - DNA, 330 bp, Artificial Sequence
  Description of Artificial Sequence: Synthetic polynucleotide
gcgccagaggcagcaggaggaccttccgtgttcctgtttccacccaagccaaaggataccctgatgatcagccgcacccctgaggtgacatgcgtggtggtgagcgtgtcccacgaggacccagaggtgaagtttaactggtacgtggatggcgtggaggtgcacaatgccaagacaaagcctcgggaggagcagtacaattctacctatagagtggtgagcgtgctgacagtgctgcaccaggactggctgaacggcaaggagtataagtgcaaggtgtccaataaggccctgcctgccccaatcgagaagaccatctctaaggccaag

SEQ ID NO: 231 - protein, 106 aa, Artificial Sequence; identical to SEQ ID NO: 21
  Description of Artificial Sequence: Synthetic polypeptide

SEQ ID NO: 232 - DNA, 318 bp, Artificial Sequence
  Description of Artificial Sequence: Synthetic polynucleotide
ggccagcctcgcgaacctcaggtgtacgtgctgcctccatctagagacgagctgacaaagaaccaggtgagcctgctgtgcctggtgaagggcttctatccaagcgatatcgccgtggagtgggagtccaatggccagcccgagaacaattacctgacctggccccctgtgctggactctgatggcagcttctttctgtattccaagctgacagtggataagtctaggtggcagcagggcaacgtgttttcttgcagcgtgatgcacgaggccctgcacaatcactacacccagaagtccctgtctctgagccccggc

SEQ ID NO: 233 - protein, 473 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 234 - DNA, 1419 bp, Artificial Sequence
  Description of Artificial Sequence: Synthetic polynucleotide
cagatcgtcctgactcagagccccgctattatgtccgcttcccctggagaaaaggtcactatgacttgttccgcctctagttccgtctcctacatgaactggtatcagcagaaatctggaacaagtcccaagcgatggatctacgacacttccaagctggcatctggagtgcctgcccacttccgaggcagcggctctgggacaagttattcactgactatttctggcatggaggccgaagatgccgctacatactattgccagcagtggagctccaacccattcacctttggatgtggcacaaagctggagatcaatggcggaggaggctccggaggaggagggtctggaggaggaggaagtcaggtccagctgcagcagagcggagcagaactggctagaccaggagccagtgtgaaaatgtcatgcaaggccagcggctacacattcactcggtataccatgcattgggtgaaacagagaccaggacagtgtctggagtggatcggctacattaatcccagcagggggtacacaaactacaaccagaagtttaaagacaaggcaaccctgaccaccgataagtctagttcaacagcttatatgcagctgagctccctgacttcagaagacagcgctgtgtactattgcgcacgctactatgacgatcactactgtctggattattgggggcagggaactaccctgaccgtgtctagtgcagccgagcctaaatcaagcgacaagacccatacatgccccccttgtccggcgccagaagctgcaggcggaccaagcgtgttcctgtttccacccaaacctaaggatactctgatgattagccgaactcctgaggtcacctgcgtggtcgtgagcgtgtcccacgaggacccagaagtcaagttcaactggtacgtggatggggtcgaagtgcataatgccaaaaccaagcccagggaggaacagtacaactccacttatcgcgtcgtgtctgtcctgaccgtgctgcaccaggactggctgaatggcaaggagtacaaatgtaaggtctcaaataaggctctgcccgcccctatcgaaaaaactatctcaaaggcaaaaggccagcctcgcgaaccacaggtctacgtgctgccccctagccgcgacgaactgactaaaaatcaggtctctctgctgtgtctggtcaaaggattctacccttccgacatcgccgtggagtgggaaagtaacggccagcccgagaacaattacctgacctggccccctgtgctggactctgatgggagtttctttctgtattcaaagctgacagtcgataaaagccggtggcagcagggcaatgtgttcagctgctccgtcatgcacgaagcactgcacaaccattacactcagaagtccctgtccctgtcacctggc

SEQ ID NO: 235 - protein, 106 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEIN

SEQ ID NO: 236 - DNA, 318 bp, Artificial Sequence
  Description of Artificial Sequence: Synthetic polynucleotide
cagatcgtcctgactcagagccccgctattatgtccgcttcccctggagaaaaggtcactatgacttgttccgcctctagttccgtctcctacatgaactggtatcagcagaaatctggaacaagtcccaagcgatggatctacgacacttccaagctggcatctggagtgcctgcccacttccgaggcagcggctctgggacaagttattcactgactatttctggcatggaggccgaagatgccgctacatactattgccagcagtggagctccaacccattcacctttggatgtggcacaaagctggagatcaat

SEQ ID NO: 237 - protein, 5 aa, Artificial Sequence
  Description of Artificial Sequence: Synthetic peptide
SSVSY

SEQ ID NO: 238 - DNA, 15 bp, Artificial Sequence
  Description of Artificial Sequence: Synthetic oligonucleotide
agttccgtctcctac

SEQ ID NO: 239 - protein, 9 aa, Artificial Sequence
  Description of Artificial Sequence: Synthetic peptide
QQWSSNPFT

SEQ ID NO: 240 - DNA, 27 bp, Artificial Sequence
  Description of Artificial Sequence: Synthetic oligonucleotide
cagcagtggagctccaacccattcacc

SEQ ID NO: 241 - protein, 3 aa, Artificial Sequence
  Description of Artificial Sequence: Synthetic peptide
DTS

SEQ ID NO: 242 - DNA, 9 bp, Artificial Sequence
  Description of Artificial Sequence: Synthetic oligonucleotide
gacacttcc

SEQ ID NO: 243 - protein, 119 aa, Artificial Sequence
  Description of Artificial Sequence: Synthetic polypeptide
QVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYCLDYWGQGTTLTVSS

SEQ ID NO: 244 - DNA, 357 bp, Artificial Sequence
  Description of Artificial Sequence: Synthetic polynucleotide
caggtccagctgcagcagagcggagcagaactggctagaccaggagccagtgtgaaaatgtcatgcaaggccagcggctacacattcactcggtataccatgcattgggtgaaacagagaccaggacagtgtctggagtggatcggctacattaatcccagcagggggtacacaaactacaaccagaagtttaaagacaaggcaaccctgaccaccgataagtctagttcaacagcttatatgcagctgagctccctgacttcagaagacagcgctgtgtactattgcgcacgctactatgacgatcactactgtctggattattgggggcagggaactaccctgaccgtgtctagt

SEQ ID NO: 245 - protein, 8 aa, Artificial Sequence
  Description of Artificial Sequence: Synthetic peptide
GYTFTRYT

SEQ ID NO: 246 - DNA, 24 bp, Artificial Sequence
  Description of Artificial Sequence: Synthetic oligonucleotide
ggctacacattcactcggtatacc

SEQ ID NO: 247 - protein, 12 aa, Artificial Sequence
  Description of Artificial Sequence: Synthetic peptide
ARYYDDHYCLDY

SEQ ID NO: 248 - DNA, 36 bp, Artificial Sequence
  Description of Artificial Sequence: Synthetic oligonucleotide
gcacgctactatgacgatcactactgtctggattat

SEQ ID NO: 249 - protein, 8 aa, Artificial Sequence
  Description of Artificial Sequence: Synthetic peptide
INPSRGYT

SEQ ID NO: 250 - DNA, 24 bp, Artificial Sequence
  Description of Artificial Sequence: Synthetic oligonucleotide
attaatcccagcagggggtacaca

SEQ ID NO: 251 - protein, 110 aa, Artificial Sequence; identical to SEQ ID NO: 19
  Description of Artificial Sequence: Synthetic polypeptide

SEQ ID NO: 252 - DNA, 330 bp, Artificial Sequence
  Description of Artificial Sequence: Synthetic polynucleotide
gcgccagaagctgcaggcggaccaagcgtgttcctgtttccacccaaacctaaggatactctgatgattagccgaactcctgaggtcacctgcgtggtcgtgagcgtgtcccacgaggacccagaagtcaagttcaactggtacgtggatggggtcgaagtgcataatgccaaaaccaagcccagggaggaacagtacaactccacttatcgcgtcgtgtctgtcctgaccgtgctgcaccaggactggctgaatggcaaggagtacaaatgtaaggtctcaaataaggctctgcccgcccctatcgaaaaaactatctcaaaggcaaaa

SEQ ID NO: 253 - protein, 106 aa, Artificial Sequence; identical to SEQ ID NO: 21
  Description of Artificial Sequence: Synthetic polypeptide

SEQ ID NO: 254 - DNA, 318 bp, Artificial Sequence
  Description of Artificial Sequence: Synthetic polynucleotide
ggccagcctcgcgaaccacaggtctacgtgctgccccctagccgcgacgaactgactaaaaatcaggtctctctgctgtgtctggtcaaaggattctacccttccgacatcgccgtggagtgggaaagtaacggccagcccgagaacaattacctgacctggccccctgtgctggactctgatgggagtttctttctgtattcaaagctgacagtcgataaaagccggtggcagcagggcaatgtgttcagctgctccgtcatgcacgaagcactgcacaaccattacactcagaagtccctgtccctgtcacctggc

SEQ ID NO: 255 - protein, 473 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 256 - DNA, 1419 bp, Artificial Sequence
  Description of Artificial Sequence: Synthetic polynucleotide
cagatcgtcctgactcagagccccgctattatgtccgcaagccctggagagaaagtgactatgacctgttccgcatctagttccgtgtcctacatgaactggtatcagcagaaatctggaacaagtcccaagcgatggatctacgacacttccaagctggcatctggagtgcctgcccacttccgaggcagcggctctgggacaagttattcactgactattagcggcatggaggccgaagatgccgctacatactattgccagcagtggagctccaacccattcacctttggatgtggcacaaagctggagatcaatggcggaggaggctccggaggaggagggtctggaggaggaggaagtcaggtccagctgcagcagtccggagcagaactggctagaccaggagccagtgtgaaaatgtcatgcaaggccagcggctacacattcactcggtataccatgcattgggtgaaacagagaccaggacagtgtctggagtggatcggctacattaatcccagcagggggtacacaaactacaaccagaagtttaaagacaaggcaaccctgaccaccgataagtctagttcaacagcttatatgcagctgagctccctgacttcagaagacagcgctgtgtactattgcgcacgctactatgacgatcactactccctggattattgggggcagggaactaccctgaccgtgtctagtgcagccgagcctaaatcaagcgacaagacccatacatgccccccttgtccggcgccagaagctgcaggcggaccaagtgtgttcctgtttccacccaaacctaaggatactctgatgatttctcgaactcctgaggtcacctgcgtggtcgtgagcgtgtcccacgaggacccagaagtcaagttcaactggtacgtggatggggtcgaagtgcataatgccaaaaccaagcccagggaggaacagtacaactcaacttatcgcgtcgtgtctgtcctgaccgtgctgcaccaggactggctgaatggcaaggagtacaaatgtaaggtctcaaataaggctctgcccgcccctatcgaaaaaactatctctaaggcaaaaggacagcctcgcgaaccacaggtctacgtgctgccccctagccgcgacgaactgactaaaaatcaggtctctctgctgtgtctggtcaaaggattctacccttccgacatcgccgtggagtgggaaagtaacggccagcccgagaacaattacctgacctggccccctgtgctggactctgatgggagtttctttctgtattcaaagctgacagtcgataaaagccggtggcagcagggcaatgtgttcagctgctccgtcatgcacgaagcactgcacaaccattacactcagaagtccctgtccctgtcacctggc

SEQ ID NO: 257 - protein, 106 aa, Artificial Sequence; identical to SEQ ID NO: 235
  Description of Artificial Sequence: Synthetic polypeptide

SEQ ID NO: 258 - DNA, 318 bp, Artificial Sequence
  Description of Artificial Sequence: Synthetic polynucleotide
cagatcgtcctgactcagagccccgctattatgtccgcaagccctggagagaaagtgactatgacctgttccgcatctagttccgtgtcctacatgaactggtatcagcagaaatctggaacaagtcccaagcgatggatctacgacacttccaagctggcatctggagtgcctgcccacttccgaggcagcggctctgggacaagttattcactgactattagcggcatggaggccgaagatgccgctacatactattgccagcagtggagctccaacccattcacctttggatgtggcacaaagctggagatcaat

SEQ ID NO: 259 - protein, 5 aa, Artificial Sequence
  Description of Artificial Sequence: Synthetic peptide
SSVSY

SEQ ID NO: 260 - DNA, 15 bp, Artificial Sequence
  Description of Artificial Sequence: Synthetic oligonucleotide
agttccgtgtcctac

SEQ ID NO: 261 - protein, 9 aa, Artificial Sequence
  Description of Artificial Sequence: Synthetic peptide
QQWSSNPFT

SEQ ID NO: 262 - DNA, 27 bp, Artificial Sequence
  Description of Artificial Sequence: Synthetic oligonucleotide
cagcagtggagctccaacccattcacc

SEQ ID NO: 263 - protein, 3 aa, Artificial Sequence
  Description of Artificial Sequence: Synthetic peptide
DTS

SEQ ID NO: 264 - DNA, 9 bp, Artificial Sequence
  Description of Artificial Sequence: Synthetic oligonucleotide
gacacttcc

SEQ ID NO: 265 - protein, 119 aa, Artificial Sequence
  Description of Artificial Sequence: Synthetic polypeptide
QVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYSLDYWGQGTTLTVSS

SEQ ID NO: 266 - DNA, 357 bp, Artificial Sequence
  Description of Artificial Sequence: Synthetic polynucleotide
caggtccagctgcagcagtccggagcagaactggctagaccaggagccagtgtgaaaatgtcatgcaaggccagcggctacacattcactcggtataccatgcattgggtgaaacagagaccaggacagtgtctggagtggatcggctacattaatcccagcagggggtacacaaactacaaccagaagtttaaagacaaggcaaccctgaccaccgataagtctagttcaacagcttatatgcagctgagctccctgacttcagaagacagcgctgtgtactattgcgcacgctactatgacgatcactactccctggattattgggggcagggaactaccctgaccgtgtctagt

SEQ ID NO: 267 - protein, 8 aa, Artificial Sequence
  Description of Artificial Sequence: Synthetic peptide
GYTFTRYT

SEQ ID NO: 268 - DNA, 24 bp, Artificial Sequence
  Description of Artificial Sequence: Synthetic oligonucleotide
ggctacacattcactcggtatacc

SEQ ID NO: 269 - protein, 12 aa, Artificial Sequence
  Description of Artificial Sequence: Synthetic peptide
ARYYDDHYSLDY

SEQ ID NO: 270 - DNA, 36 bp, Artificial Sequence
  Description of Artificial Sequence: Synthetic oligonucleotide
gcacgctactatgacgatcactactccctggattat

SEQ ID NO: 271 - protein, 8 aa, Artificial Sequence
  Description of Artificial Sequence: Synthetic peptide
INPSRGYT

SEQ ID NO: 272 - DNA, 24 bp, Artificial Sequence
  Description of Artificial Sequence: Synthetic oligonucleotide
attaatcccagcagggggtacaca

SEQ ID NO: 273 - protein, 110 aa, Artificial Sequence; identical to SEQ ID NO: 19
  Description of Artificial Sequence: Synthetic polypeptide

SEQ ID NO: 274 - DNA, 330 bp, Artificial Sequence
  Description of Artificial Sequence: Synthetic polynucleotide
gcgccagaagctgcaggcggaccaagtgtgttcctgtttccacccaaacctaaggatactctgatgatttctcgaactcctgaggtcacctgcgtggtcgtgagcgtgtcccacgaggacccagaagtcaagttcaactggtacgtggatggggtcgaagtgcataatgccaaaaccaagcccagggaggaacagtacaactcaacttatcgcgtcgtgtctgtcctgaccgtgctgcaccaggactggctgaatggcaaggagtacaaatgtaaggtctcaaataaggctctgcccgcccctatcgaaaaaactatctctaaggcaaaa

SEQ ID NO: 275 - protein, 106 aa, Artificial Sequence; identical to SEQ ID NO: 21
  Description of Artificial Sequence: Synthetic polypeptide

SEQ ID NO: 276 - DNA, 318 bp, Artificial Sequence; identical to SEQ ID NO: 150
  Description of Artificial Sequence: Synthetic polynucleotide

SEQ ID NO: 277 - protein, 483 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGCGTKLEIKGGGGSGGGGSGGGGSQVQLQQSGAELVRPGSSVKISCKASGYAFSSYWMNWVKQRPGQCLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 278 - DNA, 1449 bp, Artificial Sequence
  Description of Artificial Sequence: Synthetic polynucleotide
gatattcagctgacacagagccccgcatccctggccgtgagcctgggacagagagcaactatttcctgcaaagcctcacagagcgtggactatgatggagacagctatctgaactggtaccagcagatcccaggccagccccctaaactgctgatctacgacgccagcaatctggtgtccggcatcccacccaggttcagtggatcaggcagcgggaccgattttacactgaacattcaccctgtcgagaaggtggacgccgctacctaccattgccagcagtccacagaggacccctggactttcggatgtggcaccaaactggaaatcaagggcgggggaggctcaggaggaggagggagcggaggaggaggcagccaggtgcagctgcagcagagcggagcagaactggtccgacctggaagctccgtgaaaatttcttgcaaggccagtggctatgctttttctagttactggatgaattgggtgaagcagcgaccaggacagtgtctggagtggatcgggcagatttggcctggggatggagacaccaactataatggaaagttcaaaggcaaggcaactctgaccgccgacgaatcaagctccacagcttatatgcagctgtctagtctggctagtgaggattcagcagtgtacttttgcgcccggagagaaaccacaactgtgggcagatactattacgcaatggactactggggccaggggaccacagtcaccgtgtcaagcgcagccgagcccaaatcctctgataagacacacacttgccctccatgtccggcgccagaagctgcaggcggaccttccgtgttcctgtttccccctaaaccaaaggacactctgatgatctctcgcactccagaggtcacctgcgtggtcgtgtccgtgtctcacgaggaccccgaagtcaaattcaactggtatgtggacggggtcgaagtgcataatgccaaaacaaagcctagggaggaacagtataactctacataccgcgtcgtgagtgtcctgactgtgctgcatcaggattggctgaatggcaaggagtacaaatgtaaggtctcaaataaggctctgcccgcccctatcgaaaaaactatctctaaagctaaaggccagcctcgcgaaccacaggtctacgtgctgccccctagccgcgacgaactgactaaaaatcaggtctctctgctgtgtctggtcaaaggattctacccttccgacatcgccgtggagtgggaaagtaacggccagcccgagaacaattacctgacctggccccctgtgctggactctgatgggagtttctttctgtattcaaagctgacagtcgataaaagccggtggcagcagggcaatgtgttcagctgctccgtcatgcacgaagcactgcacaaccattacactcagaagtccctgtccctgtcacctggc

SEQ ID NO: 279 - protein, 111 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGCGTKLEIK

SEQ ID NO: 280 - DNA, 333 bp, Artificial Sequence
  Description of Artificial Sequence: Synthetic polynucleotide
gatattcagctgacacagagccccgcatccctggccgtgagcctgggacagagagcaactatttcctgcaaagcctcacagagcgtggactatgatggagacagctatctgaactggtaccagcagatcccaggccagccccctaaactgctgatctacgacgccagcaatctggtgtccggcatcccacccaggttcagtggatcaggcagcgggaccgattttacactgaacattcaccctgtcgagaaggtggacgccgctacctaccattgccagcagtccacagaggacccctggactttcggatgtggcaccaaactggaaatcaag

SEQ ID NO: 281 - protein, 10 aa, Artificial Sequence
  Description of Artificial Sequence: Synthetic peptide
QSVDYDGDSY

SEQ ID NO: 282 - DNA, 30 bp, Artificial Sequence
  Description of Artificial Sequence: Synthetic oligonucleotide
cagagcgtggactatgatggagacagctat

SEQ ID NO: 283 - protein, 9 aa, Artificial Sequence
  Description of Artificial Sequence: Synthetic peptide
QQSTEDPWT

SEQ ID NO: 284 - DNA, 27 bp, Artificial Sequence
  Description of Artificial Sequence: Synthetic oligonucleotide
cagcagtccacagaggacccctggact

SEQ ID NO: 285 - protein, 3 aa, Artificial Sequence
  Description of Artificial Sequence: Synthetic peptide
DAS

SEQ ID NO: 286 - DNA, 9 bp, Artificial Sequence
  Description of Artificial Sequence: Synthetic oligonucleotide
gacgccagc

SEQ ID NO: 287 - protein, 124 aa, Artificial Sequence
  Description of Artificial Sequence: Synthetic polypeptide
QVQLQQSGAELVRPGSSVKISCKASGYAFSSYWMNWVKQRPGQCLEWIGQIWPGDGDTNYNGKFKGKATLTADESSSTAYMQLSSLASEDSAVYFCARRETTTVGRYYYAMDYWGQGTTVTVSS

SEQ ID NO: 288 - DNA, 372 bp, Artificial Sequence
  Description of Artificial Sequence: Synthetic polynucleotide
caggtgcagctgcagcagagcggagcagaactggtccgacctggaagctccgtgaaaatttcttgcaaggccagtggctatgctttttctagttactggatgaattgggtgaagcagcgaccaggacagtgtctggagtggatcgggcagatttggcctggggatggagacaccaactataatggaaagttcaaaggcaaggcaactctgaccgccgacgaatcaagctccacagcttatatgcagctgtctagtctggctagtgaggattcagcagtgtacttttgcgcccggagagaaaccacaactgtgggcagatactattacgcaatggactactggggccaggggaccacagtcaccgtgtcaagc

SEQ ID NO: 289 - protein, 8 aa, Artificial Sequence
  Description of Artificial Sequence: Synthetic peptide
GYAFSSYW

SEQ ID NO: 290 - DNA, 24 bp, Artificial Sequence
  Description of Artificial Sequence: Synthetic oligonucleotide
ggctatgctttttctagttactgg

SEQ ID NO: 291 - protein, 17 aa, Artificial Sequence
  Description of Artificial Sequence: Synthetic peptide
ARRETTTVGRYYYAMDY

SEQ ID NO: 292 - DNA, 51 bp, Artificial Sequence
  Description of Artificial Sequence: Synthetic oligonucleotide
gcccggagagaaaccacaactgtgggcagatactattacgcaatggactac

SEQ ID NO: 293 - protein, 8 aa, Artificial Sequence
  Description of Artificial Sequence: Synthetic peptide
IWPGDGDT

SEQ ID NO: 294 - DNA, 24 bp, Artificial Sequence
  Description of Artificial Sequence: Synthetic oligonucleotide
atttggcctggggatggagacacc

SEQ ID NO: 295 - protein, 110 aa, Artificial Sequence; identical to SEQ ID NO: 19
  Description of Artificial Sequence: Synthetic polypeptide

SEQ ID NO: 296 - DNA, 330 bp, Artificial Sequence
  Description of Artificial Sequence: Synthetic polynucleotide
gcgccagaagctgcaggcggaccttccgtgttcctgtttccccctaaaccaaaggacactctgatgatctctcgcactccagaggtcacctgcgtggtcgtgtccgtgtctcacgaggaccccgaagtcaaattcaactggtatgtggacggggtcgaagtgcataatgccaaaacaaagcctagggaggaacagtataactctacataccgcgtcgtgagtgtcctgactgtgctgcatcaggattggctgaatggcaaggagtacaaatgtaaggtctcaaataaggctctgcccgcccctatcgaaaaaactatctctaaagctaaa

SEQ ID NO: 297 - protein, 106 aa, Artificial Sequence; identical to SEQ ID NO: 21
  Description of Artificial Sequence: Synthetic polypeptide

SEQ ID NO: 298 - DNA, 318 bp, Artificial Sequence; identical to SEQ ID NO: 254
  Description of Artificial Sequence: Synthetic polynucleotide

SEQ ID NO: 299 - protein, 483 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGCGTKLEIKGGGGSGGGGSGGGGSQVQLQQSGAELVRPGSSVKISCKASGYAFSSYWMNWVKQRPGQCLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 300 - DNA, 1449 bp, Artificial Sequence
  Description of Artificial Sequence: Synthetic polynucleotide
gacatccagctgacacagagccccgcaagcctggccgtgagcctgggacagagagccactatttcatgcaaagcctcacagagcgtggactatgatggagacagctatctgaactggtaccagcagatcccaggccagccccctaaactgctgatctacgacgccagcaatctggtgtccggcatcccacccaggttcagtggatcaggcagcgggaccgattttacactgaacattcaccctgtcgagaaggtggacgccgctacctaccattgccagcagtccacagaggacccctggactttcggatgtggcaccaaactggaaatcaagggcgggggaggctcaggaggaggagggagcggaggaggaggcagccaggtgcagctgcagcagagcggagcagaactggtccgacctggaagctccgtgaaaatttcttgcaaggccagtggctatgctttttctagttactggatgaattgggtgaagcagcgaccaggacagtgtctggagtggatcgggcagatttggcctggggatggagacaccaactataatggaaagttcaaaggcaaggcaactctgaccgccgacgaatcaagctccacagcttatatgcagctgtctagtctggctagtgaggattcagcagtgtacttttgcgcccggagagaaaccacaactgtgggcagatactattacgcaatggactactggggccaggggaccacagtcaccgtgtcaagcgcagccgagcccaaatcctctgataagacacacacttgccctccatgtccggcgccagaagctgcaggcggaccttccgtgttcctgtttccccctaaaccaaaggacactctgatgatctctcgcactccagaggtcacctgcgtggtcgtgtccgtgtctcacgaggaccccgaagtcaaattcaactggtatgtggacggggtcgaagtgcataatgccaaaacaaagcctagggaggaacagtataactctacataccgcgtcgtgagtgtcctgactgtgctgcatcaggattggctgaatggcaaggagtacaaatgtaaggtgagcaacaaagcactgcccgcccctatcgaaaaaactattagcaaagcaaaaggacagcctcgcgaaccacaggtctacgtctaccccccatcaagagatgaactgacaaaaaatcaggtctctctgacatgcctggtcaaaggattctacccttccgacatcgccgtggagtgggaaagtaacggccagcccgagaacaattacaagaccacaccccctgtcctggactctgatgggagtttcgctctggtgtcaaagctgaccgtcgataaaagccggtggcagcagggcaatgtgtttagctgctccgtcatgcacgaagccctgcacaatcactacacacagaagtccctgagcctgagccctggc

SEQ ID NO: 301 - protein, 111 aa, Artificial Sequence; identical to SEQ ID NO: 279
  Description of Artificial Sequence: Synthetic polypeptide

SEQ ID NO: 302 - DNA, 333 bp, Artificial Sequence
  Description of Artificial Sequence: Synthetic polynucleotide
gacatccagctgacacagagccccgcaagcctggccgtgagcctgggacagagagccactatttcatgcaaagcctcacagagcgtggactatgatggagacagctatctgaactggtaccagcagatcccaggccagccccctaaactgctgatctacgacgccagcaatctggtgtccggcatcccacccaggttcagtggatcaggcagcgggaccgattttacactgaacattcaccctgtcgagaaggtggacgccgctacctaccattgccagcagtccacagaggacccctggactttcggatgtggcaccaaactggaaatcaag

SEQ ID NO: 303 - protein, 10 aa, Artificial Sequence
  Description of Artificial Sequence: Synthetic peptide
QSVDYDGDSY

SEQ ID NO: 304 - DNA, 30 bp, Artificial Sequence; identical to SEQ ID NO: 282
  Description of Artificial Sequence: Synthetic oligonucleotide

SEQ ID NO: 305 - protein, 9 aa, Artificial Sequence
  Description of Artificial Sequence: Synthetic peptide
QQSTEDPWT

SEQ ID NO: 306 - DNA, 27 bp, Artificial Sequence
  Description of Artificial Sequence: Synthetic oligonucleotide
cagcagtccacagaggacccctggact

SEQ ID NO: 307 - protein, 3 aa, Artificial Sequence
  Description of Artificial Sequence: Synthetic peptide
DAS

SEQ ID NO: 308 - DNA, 9 bp, Artificial Sequence
  Description of Artificial Sequence: Synthetic oligonucleotide
gacgccagc

SEQ ID NO: 309 - protein, 124 aa, Artificial Sequence; identical to SEQ ID NO: 287
  Description of Artificial Sequence: Synthetic polypeptide

SEQ ID NO: 310 - DNA, 372 bp, Artificial Sequence; identical to SEQ ID NO: 288
  Description of Artificial Sequence: Synthetic polynucleotide

SEQ ID NO: 311 - protein, 8 aa, Artificial Sequence
  Description of Artificial Sequence: Synthetic peptide
GYAFSSYW

SEQ ID NO: 312 - DNA, 24 bp, Artificial Sequence
  Description of Artificial Sequence: Synthetic oligonucleotide
ggctatgctttttctagttactgg

SEQ ID NO: 313 - protein, 17 aa, Artificial Sequence
  Description of Artificial Sequence: Synthetic peptide
ARRETTTVGRYYYAMDY

SEQ ID NO: 314 - DNA, 51 bp, Artificial Sequence; identical to SEQ ID NO: 292
  Description of Artificial Sequence: Synthetic oligonucleotide

SEQ ID NO: 315 - protein, 8 aa, Artificial Sequence
  Description of Artificial Sequence: Synthetic peptide
IWPGDGDT

SEQ ID NO: 316 - DNA, 24 bp, Artificial Sequence
  Description of Artificial Sequence: Synthetic oligonucleotide
atttggcctggggatggagacacc

SEQ ID NO: 317 - protein, 110 aa, Artificial Sequence; identical to SEQ ID NO: 19
  Description of Artificial Sequence: Synthetic polypeptide

SEQ ID NO: 318 - DNA, 330 bp, Artificial Sequence
  Description of Artificial Sequence: Synthetic polynucleotide
gcgccagaagctgcaggcggaccttccgtgttcctgtttccccctaaaccaaaggacactctgatgatctctcgcactccagaggtcacctgcgtggtcgtgtccgtgtctcacgaggaccccgaagtcaaattcaactggtatgtggacggggtcgaagtgcataatgccaaaacaaagcctagggaggaacagtataactctacataccgcgtcgtgagtgtcctgactgtgctgcatcaggattggctgaatggcaaggagtacaaatgtaaggtgagcaacaaagcactgcccgcccctatcgaaaaaactattagcaaagcaaaa

SEQ ID NO: 319 - protein, 106 aa, Artificial Sequence; identical to SEQ ID NO: 89
  Description of Artificial Sequence: Synthetic polypeptide

SEQ ID NO: 320 - DNA, 318 bp, Artificial Sequence
  Description of Artificial Sequence: Synthetic polynucleotide
ggacagcctcgcgaaccacaggtctacgtctaccccccatcaagagatgaactgacaaaaaatcaggtctctctgacatgcctggtcaaaggattctacccttccgacatcgccgtggagtgggaaagtaacggccagcccgagaacaattacaagaccacaccccctgtcctggactctgatgggagtttcgctctggtgtcaaagctgaccgtcgataaaagccggtggcagcagggcaatgtgtttagctgctccgtcatgcacgaagccctgcacaatcactacacacagaagtccctgagcctgagccctggc

SEQ ID NO: 321 - protein, 218 aa, Artificial Sequence
  Description of Artificial Sequence: Synthetic polypeptide
DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - DNA, 651 bp, Artificial Sequence
  Description of Artificial Sequence: Synthetic polynucleotide
gacattcagctgacccagagcccttcctccctgagcgccagcgtgggagaccgggccacaatcacctgcagggccagccaatccgtggactacgagggcgactcctacctgaactggtatcagcagaagcccggcaaggcccccaagctgctgatctacgacgcctccaacctggtgtccggcatcccttccaggtttagcggctccggcagcggcaccgatttcaccctgaccatcagcagcgtgcagcccgaggacgctgccacctactactgccagcagagcaccgaggacccctggaccttcggctgtggcacaaagctggagatcaagaggaccgtggccgctccctccgtgttcatcttcccccccagcgatgaacagctgaagtccggcacagcttccgtggtgtgcctgctcaacaacttctaccccagggaagccaaggtgcagtggaaagttgataacgccctgcagagcggcaactcccaggagtccgtgacagagcaggacagcaaggactccacctactccctgtcctccaccctgaccctgtccaaggccgattacgagaagcacaaggtgtacgcctgcgaggtgacacaccagggcctgtcctcccccgtgaccaagtccttcaacaggggcgag

SEQ ID NO: 323 - protein, 111 aa, Artificial Sequence
  Description of Artificial Sequence: Synthetic polypeptide
DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIK

SEQ ID NO: 324 - DNA, 333 bp, Artificial Sequence
  Description of Artificial Sequence: Synthetic polynucleotide
gacattcagctgacccagagcccttcctccctgagcgccagcgtgggagaccgggccacaatcacctgcagggccagccaatccgtggactacgagggcgactcctacctgaactggtatcagcagaagcccggcaaggcccccaagctgctgatctacgacgcctccaacctggtgtccggcatcccttccaggtttagcggctccggcagcggcaccgatttcaccctgaccatcagcagcgtgcagcccgaggacgctgccacctactactgccagcagagcaccgaggacccctggaccttcggctgtggcacaaagctggagatcaag

SEQ ID NO: 325 - protein, 10 aa, Artificial Sequence
  Description of Artificial Sequence: Synthetic peptide
QSVDYEGDSY

SEQ ID NO: 326 - DNA, 30 bp, Artificial Sequence
  Description of Artificial Sequence: Synthetic oligonucleotide
caatccgtggactacgagggcgactcctac

SEQ ID NO: 327 - protein, 9 aa, Artificial Sequence
  Description of Artificial Sequence: Synthetic peptide
QQSTEDPWT

SEQ ID NO: 328 - DNA, 27 bp, Artificial Sequence
  Description of Artificial Sequence: Synthetic oligonucleotide
cagcagagcaccgaggacccctggacc

SEQ ID NO: 329 - protein, 3 aa, Artificial Sequence
  Description of Artificial Sequence: Synthetic peptide
DAS

SEQ ID NO: 330 - DNA, 9 bp, Artificial Sequence
  Description of Artificial Sequence: Synthetic oligonucleotide
gacgcctcc

SEQ ID NO: 331 - protein, 107 aa, Artificial Sequence [sequence omitted]

SEQ ID NO: 332 - DNA, 321 bp, Artificial Sequence
  Description of Artificial Sequence: Synthetic polynucleotide
aggaccgtggccgctccctccgtgttcatcttcccccccagcgatgaacagctgaagtccggcacagcttccgtggtgtgcctgctcaacaacttctaccccagggaagccaaggtgcagtggaaagttgataacgccctgcagagcggcaactcccaggagtccgtgacagagcaggacagcaaggactccacctactccctgtcctccaccctgaccctgtccaaggccgattacgagaagcacaaggtgtacgcctgcgaggtgacacaccagggcctgtcctcccccgtgaccaagtccttcaacaggggcgagtgc

SEQ ID NO: 333 - protein, 484 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 334 - DNA, 1452 bp, Artificial Sequence
  Description of Artificial Sequence: Synthetic polynucleotide
gacattcagctgacacagagtcctgcttcactggcagtgagcctgggacagcgagcaactatctcctgcaaagctagtcagtcagtggactatgatggcgactcctatctgaactggtaccagcagatcccagggcagccccctaagctgctgatctacgacgcctcaaatctggtgagcggcatcccaccacgattcagcggcagcggctctgggactgattttaccctgaacattcacccagtcgagaaggtggacgccgctacctaccattgccagcagtctaccgaggacccctggacattcggcgggggaactaaactggaaatcaagggaggaggaggcagtggcggaggagggtcaggaggaggaggaagccaggtgcagctgcagcagagcggagcagagctggtcagaccaggaagctccgtgaaaatttcctgtaaggcatctggctatgccttttctagttactggatgaattgggtgaagcagaggccaggacagggcctggaatggatcgggcagatttggcccggggatggagacactaactataatggaaagttcaaaggcaaggctacactgactgcagacgagtcaagctccaccgcttatatgcagctgtctagtctggccagcgaggattccgctgtctacttttgcgcacggagagaaaccacaactgtgggcaggtactattacgcaatggactactggggccaggggaccacagtcaccgtgtcaagcgcagccgaacccaaatcctctgataagacccacacatgccctccatgtccagcacctgagctgctgggaggaccaagcgtgttcctgtttccacctaaacctaaggacaccctgatgatctctcggacacccgaagtcacttgtgtggtcgtggatgtgagccacgaggaccctgaagtcaaattcaactggtacgtggatggcgtcgaggtgcataatgccaaaacaaagcctagggaggaacagtataactccacttaccgcgtcgtgtctgtcctgaccgtgctgcatcaggactggctgaacggaaaggagtacaaatgcaaggtgagcaacaaggccctgccagctcccatcgagaagaccatttccaaagctaagggccagcctcgagaaccacaggtgtatacatacccacccagccgggacgagctgaccaaaaaccaggtctccctgacatgtctggtgaagggattttatccttctgatattgccgtggagtgggaaagtaatggccagccagaaaacaattacaagactacccctccagtgctggattctgacgggagtttcgcactggtcagtaaactgacagtggataagtcacggtggcagcagggaaacgtctttagttgttcagtgatgcacgaggccctgcacaatcattacactcagaaaagcctgtccctgtctcccggcaag

SEQ ID NO: 335 - protein, 111 aa, Artificial Sequence; identical to SEQ ID NO: 59
  Description of Artificial Sequence: Synthetic polypeptide

SEQ ID NO: 336 - DNA, 333 bp, Artificial Sequence
  Description of Artificial Sequence: Synthetic polynucleotide
gacattcagctgacacagagtcctgcttcactggcagtgagcctgggacagcgagcaactatctcctgcaaagctagtcagtcagtggactatgatggcgactcctatctgaactggtaccagcagatcccagggcagccccctaagctgctgatctacgacgcctcaaatctggtgagcggcatcccaccacgattcagcggcagcggctctgggactgattttaccctgaacattcacccagtcgagaaggtggacgccgctacctaccattgccagcagtctaccgaggacccctggacattcggcgggggaactaaactggaaatcaag

SEQ ID NO: 337 - protein, 10 aa, Artificial Sequence
  Description of Artificial Sequence: Synthetic peptide
QSVDYDGDSY

SEQ ID NO: 338 - DNA, 30 bp, Artificial Sequence; identical to SEQ ID NO: 74
  Description of Artificial Sequence: Synthetic oligonucleotide

SEQ ID NO: 339 - protein, 9 aa, Artificial Sequence
  Description of Artificial Sequence: Synthetic peptide
QQSTEDPWT

SEQ ID NO: 340 - DNA, 27 bp, Artificial Sequence
  Description of Artificial Sequence: Synthetic oligonucleotide
cagcagtctaccgaggacccctggaca

SEQ ID NO: 341 - protein, 3 aa, Artificial Sequence
  Description of Artificial Sequence: Synthetic peptide
DAS

SEQ ID NO: 342 - DNA, 9 bp, Artificial Sequence
  Description of Artificial Sequence: Synthetic oligonucleotide
gacgcctca

SEQ ID NO: 343 - protein, 124 aa, Artificial Sequence; identical to SEQ ID NO: 79
  Description of Artificial Sequence: Synthetic polypeptide

SEQ ID NO: 344 - DNA, 372 bp, Artificial Sequence
  Description of Artificial Sequence: Synthetic polynucleotide
caggtgcagctgcagcagagcggagcagagctggtcagaccaggaagctccgtgaaaatttcctgtaaggcatctggctatgccttttctagttactggatgaattgggtgaagcagaggccaggacagggcctggaatggatcgggcagatttggcccggggatggagacactaactataatggaaagttcaaaggcaaggctacactgactgcagacgagtcaagctccaccgcttatatgcagctgtctagtctggccagcgaggattccgctgtctacttttgcgcacggagagaaaccacaactgtgggcaggtactattacgcaatggactactggggccaggggaccacagtcaccgtgtcaagc

SEQ ID NO: 345 - protein, 8 aa, Artificial Sequence
  Description of Artificial Sequence: Synthetic peptide
GYAFSSYW

SEQ ID NO: 346 - DNA, 24 bp, Artificial Sequence
  Description of Artificial Sequence: Synthetic oligonucleotide
ggctatgccttttctagttactgg

SEQ ID NO: 347 - protein, 17 aa, Artificial Sequence
  Description of Artificial Sequence: Synthetic peptide
ARRETTTVGRYYYAMDY

SEQ ID NO: 348 - DNA, 51 bp, Artificial Sequence
  Description of Artificial Sequence: Synthetic oligonucleotide
gcacggagagaaaccacaactgtgggcaggtactattacgcaatggactac

SEQ ID NO: 349 - protein, 8 aa, Artificial Sequence
  Description of Artificial Sequence: Synthetic peptide
IWPGDGDT

SEQ ID NO: 350 - DNA, 24 bp, Artificial Sequence
  Description of Artificial Sequence: Synthetic oligonucleotide
atttggcccggggatggagacact

SEQ ID NO: 351 - protein, 110 aa, Artificial Sequence; identical to SEQ ID NO: 147
  Description of Artificial Sequence: Synthetic polypeptide

SEQ ID NO: 352 - DNA, 330 bp, Artificial Sequence
  Description of Artificial Sequence: Synthetic polynucleotide
gcacctgagctgctgggaggaccaagcgtgttcctgtttccacctaaacctaaggacaccctgatgatctctcggacacccgaagtcacttgtgtggtcgtggatgtgagccacgaggaccctgaagtcaaattcaactggtacgtggatggcgtcgaggtgcataatgccaaaacaaagcctagggaggaacagtataactccacttaccgcgtcgtgtctgtcctgaccgtgctgcatcaggactggctgaacggaaaggagtacaaatgcaaggtgagcaacaaggccctgccagctcccatcgagaagaccatttccaaagctaag

SEQ ID NO: 353 - protein, 106 aa, Artificial Sequence
  Description of Artificial Sequence: Synthetic polypeptide
GQPREPQVYTYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 354 - DNA, 318 bp, Artificial Sequence
  Description of Artificial Sequence: Synthetic polynucleotide
ggccagcctcgagaaccacaggtgtatacatacccacccagccgggacgagctgaccaaaaaccaggtctccctgacatgtctggtgaagggattttatccttctgatattgccgtggagtgggaaagtaatggccagccagaaaacaattacaagactacccctccagtgctggattctgacgggagtttcgcactggtcagtaaactgacagtggataagtcacggtggcagcagggaaacgtctttagttgttcagtgatgcacgaggccctgcacaatcattacactcagaaaagcctgtccctgtctcccggc

SEQ ID NO: 355 - protein, 477 aa, Artificial Sequence
  Description of Artificial Sequence: Synthetic polypeptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPGK

SEQ ID NO: 356 - DNA, 1431 bp, Artificial Sequence
  Description of Artificial Sequence: Synthetic polynucleotide
gatattaagctgcagcagagcggagctgagctggcacgaccaggagccagtgtgaaaatgtcatgcaagaccagcggctacacattcactcggtatacaatgcactgggtgaagcagagaccaggacagggactggaatggatcggatatattaacccttcccgaggctacaccaactataatcagaagtttaaagacaaggccactctgaccacagataagagctcctctaccgcttacatgcagctgagttcactgacaagtgaggactcagctgtgtactattgcgcaaggtactatgacgatcattactgtctggattattggggacagggcactaccctgactgtcagctccgtggaaggagggagcggaggctccggaggatctggcgggagtggaggcgtggacgatatccagctgacccagtccccagcaattatgtccgcctctcccggcgagaaagtcaccatgacatgccgcgcttctagttcagtgagctacatgaactggtatcagcagaaatcaggcactagccccaagagatggatctacgacacctccaaggtcgcatctggggtgccttataggttcagtgggtcaggaagcggcacctcctactctctgacaattagctccatggaggcagaagatgccgctacctactattgtcagcagtggtctagtaatccactgacttttggggccggaaccaaactggagctgaaggcagccgaacccaaatcaagcgacaagactcacacctgccccccttgtccagcacccgaactgctggggggacctagcgtgttcctgtttccacccaaaccaaaggatacactgatgatcagccggacacctgaggtcacttgcgtggtcgtggacgtgagccacgaggaccccgaagtcaagttcaactggtacgtggacggcgtcgaagtgcataatgctaaaactaagcctagggaggaacagtacaatagtacatatagagtcgtgtcagtgctgaccgtcctgcatcaggattggctgaacgggaaggagtacaaatgcaaggtgtccaacaaggccctgcctgctccaatcgagaagacaatttctaaagccaagggccagccccgagaacctcaggtgtatacactgcctccatcccgggacgagctgactaaaaaccaggtctctctgctgtgtctggtgaaggggttctacccatctgatattgctgtggagtgggaaagtaatggacagcccgagaacaattatatgacctggccccctgtcctggactccgatggatctttctttctgtacagcaaactgacagtggacaagtccagatggcagcagggcaacgtctttagttgttcagtgatgcacgaggccctgcacaatcattacacccagaaaagcctgtccctgtctcccggcaag

SEQ ID NO: 357 - protein, 119 aa, Artificial Sequence
  Description of Artificial Sequence: Synthetic polypeptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 358 - DNA, 357 bp, Artificial Sequence
  Description of Artificial Sequence: Synthetic polynucleotide
gatattaagctgcagcagagcggagctgagctggcacgaccaggagccagtgtgaaaatgtcatgcaagaccagcggctacacattcactcggtatacaatgcactgggtgaagcagagaccaggacagggactggaatggatcggatatattaacccttcccgaggctacaccaactataatcagaagtttaaagacaaggccactctgaccacagataagagctcctctaccgcttacatgcagctgagttcactgacaagtgaggactcagctgtgtactattgcgcaaggtactatgacgatcattactgtctggattattggggacagggcactaccctgactgtcagctcc

SEQ ID NO: 359 - protein, 8 aa, Artificial Sequence
  Description of Artificial Sequence: Synthetic peptide
GYTFTRYT

SEQ ID NO: 360 - DNA, 24 bp, Artificial Sequence
  Description of Artificial Sequence: Synthetic oligonucleotide
ggctacacattcactcggtataca

SEQ ID NO: 361 - protein, 12 aa, Artificial Sequence
  Description of Artificial Sequence: Synthetic peptide
ARYYDDHYCLDY

SEQ ID NO: 362 - DNA, 36 bp, Artificial Sequence
  Description of Artificial Sequence: Synthetic oligonucleotide
gcaaggtactatgacgatcattactgtctggattat

SEQ ID NO: 363 - protein, 8 aa, Artificial Sequence
  Description of Artificial Sequence: Synthetic peptide
INPSRGYT

SEQ ID NO: 364 - DNA, 24 bp, Artificial Sequence
  Description of Artificial Sequence: Synthetic oligonucleotide
attaacccttcccgaggctacacc

SEQ ID NO: 365 - protein, 106 aa, Artificial Sequence
  Description of Artificial Sequence: Synthetic polypeptide
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 366 - DNA, 318 bp, Artificial Sequence
  Description of Artificial Sequence: Synthetic polynucleotide
gatatccagctgacccagtccccagcaattatgtccgcctctcccggcgagaaagtcaccatgacatgccgcgcttctagttcagtgagctacatgaactggtatcagcagaaatcaggcactagccccaagagatggatctacgacacctccaaggtcgcatctggggtgccttataggttcagtgggtcaggaagcggcacctcctactctctgacaattagctccatggaggcagaagatgccgctacctactattgtcagcagtggtctagtaatccactgacttttggggccggaaccaaactggagctgaag

SEQ ID NO: 367 - protein, 5 aa, Artificial Sequence
  Description of Artificial Sequence: Synthetic peptide
SSVSY

SEQ ID NO: 368 - DNA, 15 bp, Artificial Sequence
  Description of Artificial Sequence: Synthetic oligonucleotide
agttcagtgagctac

SEQ ID NO: 369 - protein, 9 aa, Artificial Sequence
  Description of Artificial Sequence: Synthetic peptide
QQWSSNPLT

SEQ ID NO: 370 - DNA, 27 bp, Artificial Sequence
  Description of Artificial Sequence: Synthetic oligonucleotide
cagcagtggtctagtaatccactgact

SEQ ID NO: 371 - protein, 3 aa, Artificial Sequence
  Description of Artificial Sequence: Synthetic peptide
DTS

SEQ ID NO: 372 - DNA, 9 bp, Artificial Sequence
  Description of Artificial Sequence: Synthetic oligonucleotide
gacacctcc

SEQ ID NO: 373 - protein, 110 aa, Artificial Sequence; identical to SEQ ID NO: 147
  Description of Artificial Sequence: Synthetic polypeptide

SEQ ID NO: 374 - DNA, 330 bp, Artificial Sequence
  Description of Artificial Sequence: Synthetic polynucleotide
gcacccgaactgctggggggacctagcgtgttcctgtttccacccaaaccaaaggatacactgatgatcagccggacacctgaggtcacttgcgtggtcgtggacgtgagccacgaggaccccgaagtcaagttcaactggtacgtggacggcgtcgaagtgcataatgctaaaactaagcctagggaggaacagtacaatagtacatatagagtcgtgtcagtgctgaccgtcctgcatcaggattggctgaacgggaaggagtacaaatgcaaggtgtccaacaaggccctgcctgctccaatcgagaagacaatttctaaagccaag

SEQ ID NO: 375 - protein, 106 aa, Artificial Sequence
  Description of Artificial Sequence: Synthetic polypeptide
GQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPG

SEQ ID NO: 376 - DNA, 318 bp, Artificial Sequence
  Description of Artificial Sequence: Synthetic polynucleotide
ggccagccccgagaacctcaggtgtatacactgcctccatcccgggacgagctgactaaaaaccaggtctctctgctgtgtctggtgaaggggttctacccatctgatattgctgtggagtgggaaagtaatggacagcccgagaacaattatatgacctggccccctgtcctggactccgatggatctttctttctgtacagcaaactgacagtggacaagtccagatggcagcagggcaacgtctttagttgttcagtgatgcacgaggccctgcacaatcattacacccagaaaagcctgtccctgtctcccggc

SEQ ID NO: 377 - protein, 474 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLLCLVKGFYPSDIAVEWESNGQPENNYMTWPPVLDSDGSFFLYSKLTVDKSRWQQGNVFSCSVMHEALHNHYTQKSLSLSPGK

SEQ ID NO: 378 - DNA, 1422 bp, Artificial Sequence
  Description of Artificial Sequence: Synthetic polynucleotide
cagatcgtcctgacacagagcccagcaatcatgtcagccagccccggcgagaaagtcacaatgacttgctcagcaagctcctctgtgagctacatgaactggtatcagcagaaaagcggaacctcccccaagagatggatctacgacacatccaagctggcttctggagtgcctgcacacttcaggggcagcggctctgggaccagttattcactgacaatttccggcatggaggctgaagatgccgctacctactattgccagcagtggagttcaaacccattcacttttggatctggcaccaagctggaaattaatggcggaggaggctccggaggaggagggtctggaggaggaggaagtcaggtccagctgcagcagtccggagctgagctggcacgaccaggagcaagtgtgaaaatgtcctgtaaggccagcggctacaccttcacacggtataccatgcattgggtgaaacagagacccgggcagggactggaatggatcgggtacattaatcctagccgaggatacacaaactacaaccagaagtttaaagacaaggctactctgaccacagataagagctcctctaccgcatatatgcagctgagttcactgacatctgaggacagtgccgtgtactattgcgctaggtactatgacgatcactactgtctggattattggggccaggggactaccctgaccgtgagctccgcagccgaacctaaatctagtgacaagactcatacctgccccccttgtccagcaccagagctgctgggaggaccttccgtgttcctgtttccacccaaaccaaaggatactctgatgatctcccggacacctgaagtcacttgcgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggccctgcctgctccaatcgagaagacaattagcaaagccaaggggcagccccgagaacctcaggtgtacactctgcctccatctcgggacgagctgaccaaaaaccaggtcagtctgctgtgtctggtgaagggcttctatccaagcgatattgctgtggagtgggaatccaatgggcagcccgaaaacaattacatgacatggccccctgtcctggactcagatgggagcttctttctgtatagtaaactgactgtggacaagtcacggtggcagcagggaaacgtctttagctgttccgtgatgcatgaggccctgcacaatcattacacccagaaatctctgagtctgtcacccggcaag

SEQ ID NO: 379 - protein, 106 aa, Artificial Sequence [sequence omitted]

SEQ ID NO: 380 - DNA, 318 bp, Artificial Sequence
  Description of Artificial Sequence: Synthetic polynucleotide
cagatcgtcctgacacagagcccagcaatcatgtcagccagccccggcgagaaagtcacaatgacttgctcagcaagctcctctgtgagctacatgaactggtatcagcagaaaagcggaacctcccccaagagatggatctacgacacatccaagctggcttctggagtgcctgcacacttcaggggcagcggctctgggaccagttattcactgacaatttccggcatggaggctgaagatgccgctacctactattgccagcagtggagttcaaacccattcacttttggatctggcaccaagctggaaattaat

SEQ ID NO: 381 - protein, 5 aa, Artificial Sequence
  Description of Artificial Sequence: Synthetic peptide
SSVSY

SEQ ID NO: 382 - DNA, 15 bp, Artificial Sequence
  Description of Artificial Sequence: Synthetic oligonucleotide
tcctctgtgagctac

SEQ ID NO: 383 - protein, 9 aa, Artificial Sequence
  Description of Artificial Sequence: Synthetic peptide
QQWSSNPFT

SEQ ID NO: 384 - DNA, 27 bp, Artificial Sequence
  Description of Artificial Sequence: Synthetic oligonucleotide
cagcagtggagttcaaacccattcact

SEQ ID NO: 385 - protein, 3 aa, Artificial Sequence
  Description of Artificial Sequence: Synthetic peptide
DTS

SEQ ID NO: 386 - DNA, 9 bp, Artificial Sequence
  Description of Artificial Sequence: Synthetic oligonucleotide
gacacatcc

SEQ ID NO: 387 - protein, 119 aa, Artificial Sequence [sequence omitted]

SEQ ID NO: 388 - DNA, 357 bp, Artificial Sequence
  Description of Artificial Sequence: Synthetic polynucleotide
caggtccagctgcagcagtccggagctgagctggcacgaccaggagcaagtgtgaaaatgtcctgtaaggccagcggctacaccttcacacggtataccatgcattgggtgaaacagagacccgggcagggactggaatggatcgggtacattaatcctagccgaggatacacaaactacaaccagaagtttaaagacaaggctactctgaccacagataagagctcctctaccgcatatatgcagctgagttcactgacatctgaggacagtgccgtgtactattgcgctaggtactatgacgatcactactgtctggattattggggccaggggactaccctgaccgtgagctcc

SEQ ID NO: 389 - protein, 8 aa, Artificial Sequence
  Description of Artificial Sequence: Synthetic peptide
GYTFTRYT

SEQ ID NO: 390 - DNA, 24 bp, Artificial Sequence
  Description of Artificial Sequence: Synthetic oligonucleotide
ggctacaccttcacacggtatacc

SEQ ID NO: 391 - protein, 12 aa, Artificial Sequence
  Description of Artificial Sequence: Synthetic peptide
ARYYDDHYCLDY

SEQ ID NO: 392 - DNA, 36 bp, Artificial Sequence
  Description of Artificial Sequence: Synthetic oligonucleotide
gctaggtactatgacgatcactactgtctggattat

SEQ ID NO: 393 - protein, 8 aa, Artificial Sequence
  Description of Artificial Sequence: Synthetic peptide
INPSRGYT

SEQ ID NO: 394 - DNA, 24 bp, Artificial Sequence
  Description of Artificial Sequence: Synthetic oligonucleotide
attaatcctagccgaggatacaca

SEQ ID NO: 395 - protein, 110 aa, Artificial Sequence; identical to SEQ ID NO: 147
  Description of Artificial Sequence: Synthetic polypeptide

SEQ ID NO: 396 - DNA, 330 bp, Artificial Sequence
  Description of Artificial Sequence: Synthetic polynucleotide
gcaccagagctgctgggaggaccttccgtgttcctgtttccacccaaaccaaaggatactctgatgatctcccggacacctgaagtcacttgcgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggccctgcctgctccaatcgagaagacaattagcaaagccaag

SEQ ID NO: 397 - protein, 106 aa, Artificial Sequence; identical to SEQ ID NO: 375
  Description of Artificial Sequence: Synthetic polypeptide

SEQ ID NO: 398 - DNA, 318 bp, Artificial Sequence
  Description of Artificial Sequence: Synthetic polynucleotide
gggcagccccgagaacctcaggtgtacactctgcctccatctcgggacgagctgaccaaaaaccaggtcagtctgctgtgtctggtgaagggcttctatccaagcgatattgctgtggagtgggaatccaatgggcagcccgaaaacaattacatgacatggccccctgtcctggactcagatgggagcttctttctgtatagtaaactgactgtggacaagtcacggtggcagcagggaaacgtctttagctgttccgtgatgcatgaggccctgcacaatcattacacccagaaatctctgagtctgtcacccggc

SEQ ID NO: 399 - protein, 214 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 400 - DNA, 642 bp, Artificial Sequence
  Description of Artificial Sequence: Synthetic polynucleotide
gacatcctgctgactcagagcccagtgatcctgtcagtcagcccaggagagcgggtgtccttctcttgcagagcaagtcagtcaatcggaacaaatattcactggtaccagcagaggactaacggctcccctcgcctgctgattaagtatgctagcgaatccatctctggcattccatctcggttcagtggctcagggagcggaacagactttactctgtccatcaattctgtggagagtgaagacattgccgattactattgccagcagaacaataactggcccaccacattcggcgctgggaccaagctggagctgaaacgaacagtggccgctccttctgtcttcatctttccccctagtgacgaacagctgaaaagcggcacagcctccgtggtctgtctgctgaataacttttacccaagagaggcaaaggtgcagtggaaagtcgataatgccctgcagtcagggaacagccaggagtccgtgactgaacaggactctaaggatagtacctattcactgagctccactctgaccctgtccaaagctgattacgagaagcacaaagtgtatgcatgcgaagtcacccatcaggggctgtctagtcccgtgacaaagagctttaaccggggagagtgt

SEQ ID NO: 401 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 402 - DNA, 321 bp, Artificial Sequence
  Description of Artificial Sequence: Synthetic polynucleotide
gacatcctgctgactcagagcccagtgatcctgtcagtcagcccaggagagcgggtgtccttctcttgcagagcaagtcagtcaatcggaacaaatattcactggtaccagcagaggactaacggctcccctcgcctgctgattaagtatgctagcgaatccatctctggcattccatctcggttcagtggctcagggagcggaacagactttactctgtccatcaattctgtggagagtgaagacattgccgattactattgccagcagaacaataactggcccaccacattcggcgctgggaccaagctggagctgaaa

SEQ ID NO: 403 - protein, 6 aa, Artificial Sequence
  Description of Artificial Sequence: Synthetic peptide
QSIGTN

SEQ ID NO: 404 - DNA, 18 bp, Artificial Sequence
  Description of Artificial Sequence: Synthetic oligonucleotide
cagtcaatcggaacaaat

SEQ ID NO: 405 - protein, 9 aa, Artificial Sequence
  Description of Artificial Sequence: Synthetic peptide
QQNNNWPTT

SEQ ID NO: 406 - DNA, 27 bp, Artificial Sequence
  Description of Artificial Sequence: Synthetic oligonucleotide
cagcagaacaataactggcccaccaca

SEQ ID NO: 407 - protein, 3 aa, Artificial Sequence
  Description of Artificial Sequence: Synthetic peptide
YAS

SEQ ID NO: 408 - DNA, 9 bp, Artificial Sequence
  Description of Artificial Sequence: Synthetic oligonucleotide
tatgctagc

SEQ ID NO: 409 - protein, 107 aa, Artificial Sequence [sequence omitted]

SEQ ID NO: 410 - DNA, 321 bp, Artificial Sequence
  Description of Artificial Sequence: Synthetic polynucleotide
cgaacagtggccgctccttctgtcttcatctttccccctagtgacgaacagctgaaaagcggcacagcctccgtggtctgtctgctgaataacttttacccaagagaggcaaaggtgcagtggaaagtcgataatgccctgcagtcagggaacagccaggagtccgtgactgaacaggactctaaggatagtacctattcactgagctccactctgaccctgtccaaagctgattacgagaagcacaaagtgtatgcatgcgaagtcacccatcaggggctgtctagtcccgtgacaaagagctttaaccggggagagtgt

SEQ ID NO: 411 - protein, 484 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 412 - DNA, 1452 bp, Artificial Sequence
  Description of Artificial Sequence: Synthetic polynucleotide
gatattcagctgacacagagtcctgcttcactggcagtgagcctgggacagcgagcaactatctcctgcaaagctagtcagtcagtggactatgatggcgactcctatctgaactggtaccagcagatcccagggcagccccctaagctgctgatctacgacgcctcaaatctggtgagcggcatcccaccacgattcagcggcagcggctctgggactgattttaccctgaacattcacccagtcgagaaggtggacgccgctacctaccattgccagcagtctaccgaggacccctggacattcggcgggggaactaaactggaaatcaagggaggaggaggcagtggcggaggagggtcaggaggaggaggaagccaggtgcagctgcagcagagcggagcagagctggtcagaccaggaagctccgtgaaaatttcctgtaaggcatctggctatgccttttctagttactggatgaattgggtgaagcagaggccaggacagggcctggaatggatcgggcagatttggcccggggatggagacaccaactataatggaaagttcaaaggcaaggctacactgactgcagacgagtcaagctccacagcttatatgcagctgtctagtctggccagcgaggattccgctgtgtacttttgcgcacggagagaaaccacaactgtgggcaggtactattacgcaatggactactggggccaggggaccacagtcaccgtgtcaagcgcagccgaacccaaatcctctgataagacccacacatgccctccatgtccagcacctgagctgctgggaggaccaagcgtgttcctgtttccacctaaacctaaggacacactgatgatctctcggacacccgaagtcacttgtgtggtcgtggatgtgagccacgaggaccctgaagtcaaattcaactggtacgtggatggcgtcgaggtgcataatgccaaaactaagcctagggaggaacagtataactccacttaccgcgtcgtgtctgtcctgaccgtgctgcatcaggactggctgaacggaaaggagtacaaatgcaaggtgagcaacaaggccctgccagctcccatcgagaagacaatttccaaagctaagggccagcctcgagaaccacaggtctatgtgtacccacccagccgggacgagctgaccaaaaaccaggtctccctgacatgtctggtgaagggattttatccttctgatattgccgtggagtgggaaagtaatggccagccagaaaacaattacaagactacccctccagtgctggattctgacgggagtttcgcactggtcagtaaactgactgtggataagtcacggtggcagcagggaaacgtctttagttgttcagtgatgcacgaggccctgcacaatcattacacccagaaaagcctgtccctgtctcccggcaag

SEQ ID NO: 413 - protein, 111 aa, Artificial Sequence; identical to SEQ ID NO: 59
  Description of Artificial Sequence: Synthetic polypeptide

SEQ ID NO: 414 - DNA, 333 bp, Artificial Sequence
  Description of Artificial Sequence: Synthetic polynucleotide
gatattcagctgacacagagtcctgcttcactggcagtgagcctgggacagcgagcaactatctcctgcaaagctagtcagtcagtggactatgatggcgactcctatctgaactggtaccagcagatcccagggcagccccctaagctgctgatctacgacgcctcaaatctggtgagcggcatcccaccacgattcagcggcagcggctctgggactgattttaccctgaacattcacccagtcgagaaggtggacgccgctacctaccattgccagcagtctaccgaggacccctggacattcggcgggggaactaaactggaaatcaag

SEQ ID NO: 415 - protein, 10 aa, Artificial Sequence
  Description of Artificial Sequence: Synthetic peptide
QSVDYDGDSY

SEQ ID NO: 416 - DNA, 30 bp, Artificial Sequence; identical to SEQ ID NO: 74
  Description of Artificial Sequence: Synthetic oligonucleotide

SEQ ID NO: 417 - protein, 9 aa, Artificial Sequence
  Description of Artificial Sequence: Synthetic peptide
QQSTEDPWT

SEQ ID NO: 418 - DNA, 27 bp, Artificial Sequence
  Description of Artificial Sequence: Synthetic oligonucleotide
cagcagtctaccgaggacccctggaca

SEQ ID NO: 419 - protein, 3 aa, Artificial Sequence
  Description of Artificial Sequence: Synthetic peptide
DAS

SEQ ID NO: 420 - DNA, 9 bp, Artificial Sequence
  Description of Artificial Sequence: Synthetic oligonucleotide
gacgcctca

SEQ ID NO: 421 - protein, 124 aa, Artificial Sequence; identical to SEQ ID NO: 79
  Description of Artificial Sequence: Synthetic polypeptide

SEQ ID NO: 422 - DNA, 372 bp, Artificial Sequence
  Description of Artificial Sequence: Synthetic polynucleotide
caggtgcagctgcagcagagcggagcagagctggtcagaccaggaagctccgtgaaaatttcctgtaaggcatctggctatgccttttctagttactggatgaattgggtgaagcagaggccaggacagggcctggaatggatcgggcagatttggcccggggatggagacaccaactataatggaaagttcaaaggcaaggctacactgactgcagacgagtcaagctccacagcttatatgcagctgtctagtctggccagcgaggattccgctgtgtacttttgcgcacggagagaaaccacaactgtgggcaggtactattacgcaatggactactggggccaggggaccacagtcaccgtgtcaagc

SEQ ID NO: 423 - protein, 8 aa, Artificial Sequence
  Description of Artificial Sequence: Synthetic peptide
GYAFSSYW

SEQ ID NO: 424 - DNA, 24 bp, Artificial Sequence
  Description of Artificial Sequence: Synthetic oligonucleotide
ggctatgccttttctagttactgg

SEQ ID NO: 425 - protein, 17 aa, Artificial Sequence
  Description of Artificial Sequence: Synthetic peptide
ARRETTTVGRYYYAMDY

SEQ ID NO: 426 - DNA, 51 bp, Artificial Sequence; identical to SEQ ID NO: 348
  Description of Artificial Sequence: Synthetic oligonucleotide

SEQ ID NO: 427 - protein, 8 aa, Artificial Sequence
  Description of Artificial Sequence: Synthetic peptide
IWPGDGDT

SEQ ID NO: 428 - DNA, 24 bp, Artificial Sequence
  Description of Artificial Sequence: Synthetic oligonucleotide
atttggcccggggatggagacacc

SEQ ID NO: 429 - protein, 110 aa, Artificial Sequence; identical to SEQ ID NO: 147
  Description of Artificial Sequence: Synthetic polypeptide

SEQ ID NO: 430 - DNA, 330 bp, Artificial Sequence
  Description of Artificial Sequence: Synthetic polynucleotide
gcacctgagctgctgggaggaccaagcgtgttcctgtttccacctaaacctaaggacacactgatgatctctcggacacccgaagtcacttgtgtggtcgtggatgtgagccacgaggaccctgaagtcaaattcaactggtacgtggatggcgtcgaggtgcataatgccaaaactaagcctagggaggaacagtataactccacttaccgcgtcgtgtctgtcctgaccgtgctgcatcaggactggctgaacggaaaggagtacaaatgcaaggtgagcaacaaggccctgccagctcccatcgagaagacaatttccaaagctaag

SEQ ID NO: 431 - protein, 106 aa, Artificial Sequence; identical to SEQ ID NO: 89
  Description of Artificial Sequence: Synthetic polypeptide

SEQ ID NO: 432 - DNA, 318 bp, Artificial Sequence
  Description of Artificial Sequence: Synthetic polynucleotide
ggccagcctcgagaaccacaggtctatgtgtacccacccagccgggacgagctgaccaaaaaccaggtctccctgacatgtctggtgaagggattttatccttctgatattgccgtggagtgggaaagtaatggccagccagaaaacaattacaagactacccctccagtgctggattctgacgggagtttcgcactggtcagtaaactgactgtggataagtcacggtggcagcagggaaacgtctttagttgttcagtgatgcacgaggccctgcacaatcattacacccagaaaagcctgtccctgtctcccggc

SEQ ID NO: 433 - protein, 474 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 434 - DNA, 1422 bp, Artificial Sequence
  Description of Artificial Sequence: Synthetic polynucleotide
cagatcgtcctgacacagtccccagcaatcatgtcagccagccccggggagaaagtcacaatgacttgctcagcaagctcctctgtgagctacatgaactggtatcagcagaaaagcgggacctcccccaagagatggatctacgacacatccaagctggcttctggagtgcctgcacacttcaggggcagcggctctgggaccagttattcactgacaattagcggcatggaggctgaagatgccgctacctactattgccagcagtggagttcaaacccattcacttttggatgtggcaccaagctggaaattaatggcggaggaggctccggaggaggagggtctggaggaggaggaagtcaggtgcagctgcagcagtccggagctgagctggcacgaccaggagcaagtgtgaaaatgtcatgcaaggccagcggctacaccttcacacggtataccatgcattgggtgaaacagagacccggacagtgtctggaatggatcggctacattaatccttctcgagggtacacaaactacaaccagaagtttaaagacaaggctactctgaccacagataagagctcctctaccgcatatatgcagctgagttcactgacatctgaggacagtgccgtgtactattgcgctaggtactatgacgatcactactgtctggattattgggggcagggaactaccctgacagtgagctccgcagccgaacctaaatctagtgacaagactcatacctgccccccttgtccagcaccagagctgctgggaggacctagcgtgttcctgtttccacccaaaccaaaggatactctgatgatctcccggacacctgaagtcacttgcgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggaaaggagtacaaatgcaaggtgagcaacaaggccctgcctgctccaatcgagaagacaattagcaaagccaagggccagccccgagaacctcaggtctacgtgctgcctccatctcgggacgagctgactaaaaaccaggtcagtctgctgtgtctggtgaagggattctatccaagcgatattgctgtggagtgggaatccaatggccagcccgaaaacaattacctgacttggccccctgtcctggactcagatggcagcttctttctgtatagtaaactgaccgtggacaagtcacggtggcagcaggggaacgtctttagctgttccgtgatgcatgaggccctgcacaatcattacacccagaaatctctgagtctgtcacccggcaag

SEQ ID NO: 435 - protein, 106 aa, Artificial Sequence; identical to SEQ ID NO: 235
  Description of Artificial Sequence: Synthetic polypeptide

SEQ ID NO: 436 - DNA, 318 bp, Artificial Sequence
  Description of Artificial Sequence: Synthetic polynucleotide
cagatcgtcctgacacagtccccagcaatcatgtcagccagccccggggagaaagtcacaatgacttgctcagcaagctcctctgtgagctacatgaactggtatcagcagaaaagcgggacctcccccaagagatggatctacgacacatccaagctggcttctggagtgcctgcacacttcaggggcagcggctctgggaccagttattcactgacaattagcggcatggaggctgaagatgccgctacctactattgccagcagtggagttcaaacccattcacttttggatgtggcaccaagctggaaattaat

SEQ ID NO: 437 - protein, 5 aa, Artificial Sequence
  Description of Artificial Sequence: Synthetic peptide
SSVSY

SEQ ID NO: 438 - DNA, 15 bp, Artificial Sequence
  Description of Artificial Sequence: Synthetic oligonucleotide
tcctctgtgagctac

SEQ ID NO: 439 - protein, 9 aa, Artificial Sequence
  Description of Artificial Sequence: Synthetic peptide
QQWSSNPFT

SEQ ID NO: 440 - DNA, 27 bp, Artificial Sequence
  Description of Artificial Sequence: Synthetic oligonucleotide
cagcagtggagttcaaacccattcact

SEQ ID NO: 441 - protein, 3 aa, Artificial Sequence
  Description of Artificial Sequence: Synthetic peptide
DTS

SEQ ID NO: 442 - DNA, 9 bp, Artificial Sequence
  Description of Artificial Sequence: Synthetic oligonucleotide
gacacatcc

SEQ ID NO: 443 - protein, 119 aa, Artificial Sequence; identical to SEQ ID NO: 243
  Description of Artificial Sequence: Synthetic polypeptide

SEQ ID NO: 444 - DNA, 357 bp, Artificial Sequence
  Description of Artificial Sequence: Synthetic polynucleotide
caggtgcagctgcagcagtccggagctgagctggcacgaccaggagcaagtgtgaaaatgtcatgcaaggccagcggctacaccttcacacggtataccatgcattgggtgaaacagagacccggacagtgtctggaatggatcggctacattaatccttctcgagggtacacaaactacaaccagaagtttaaagacaaggctactctgaccacagataagagctcctctaccgcatatatgcagctgagttcactgacatctgaggacagtgccgtgtactattgcgctaggtactatgacgatcactactgtctggattattgggggcagggaactaccctgacagtgagctcc

SEQ ID NO: 445 - protein, 8 aa, Artificial Sequence
  Description of Artificial Sequence: Synthetic peptide
GYTFTRYT

SEQ ID NO: 446 - DNA, 24 bp, Artificial Sequence
  Description of Artificial Sequence: Synthetic oligonucleotide
ggctacaccttcacacggtatacc

SEQ ID NO: 447 - protein, 12 aa, Artificial Sequence
  Description of Artificial Sequence: Synthetic peptide
ARYYDDHYCLDY

SEQ ID NO: 448 - DNA, 36 bp, Artificial Sequence; identical to SEQ ID NO: 392
  Description of Artificial Sequence: Synthetic oligonucleotide

SEQ ID NO: 449 - protein, 8 aa, Artificial Sequence
  Description of Artificial Sequence: Synthetic peptide
INPSRGYT

SEQ ID NO: 450 - DNA, 24 bp, Artificial Sequence
  Description of Artificial Sequence: Synthetic oligonucleotide
attaatccttctcgagggtacaca

SEQ ID NO: 451 - protein, 110 aa, Artificial Sequence; identical to SEQ ID NO: 147
  Description of Artificial Sequence: Synthetic polypeptide

SEQ ID NO: 452 - DNA, 330 bp, Artificial Sequence
  Description of Artificial Sequence: Synthetic polynucleotide
gcaccagagctgctgggaggacctagcgtgttcctgtttccacccaaaccaaaggatactctgatgatctcccggacacctgaagtcacttgcgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggaaaggagtacaaatgcaaggtgagcaacaaggccctgcctgctccaatcgagaagacaattagcaaagccaag

SEQ ID NO: 453 - protein, 106 aa, Artificial Sequence; identical to SEQ ID NO: 21
  Description of Artificial Sequence: Synthetic polypeptide

SEQ ID NO: 454 - DNA, 318 bp, Artificial Sequence
  Description of Artificial Sequence: Synthetic polynucleotide
ggccagccccgagaacctcaggtctacgtgctgcctccatctcgggacgagctgactaaaaaccaggtcagtctgctgtgtctggtgaagggattctatccaagcgatattgctgtggagtgggaatccaatggccagcccgaaaacaattacctgacttggccccctgtcctggactcagatggcagcttctttctgtatagtaaactgaccgtggacaagtcacggtggcagcaggggaacgtctttagctgttccgtgatgcatgaggccctgcacaatcattacacccagaaatctctgagtctgtcacccggc

SEQ ID NO: 455 - protein, 474 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGCGTKLEINGGGGSGGGGSGGGGSQVQLQQSGAELARPGASVKMSCKASGYTFTRYTMHWVKQRPGQCLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 456 - DNA, 1422 bp, Artificial Sequence
  Description of Artificial Sequence: Synthetic polynucleotide
cagatcgtcctgacacagagcccagcaatcatgtcagccagccccggggagaaagtcacaatgacttgctcagcaagctcctctgtgagctacatgaactggtatcagcagaaaagcgggacctcccccaagagatggatctacgacacatccaagctggcttctggagtgcctgcacacttcaggggcagcggctctgggaccagttattcactgacaatttccggcatggaggctgaagatgccgctacctactattgccagcagtggagttcaaacccattcacttttggatgtggcaccaagctggaaattaatggcggaggaggctccggaggaggagggtctggaggaggaggaagtcaggtgcagctgcagcagtccggagctgagctggcacgaccaggagcaagtgtgaaaatgtcatgcaaggccagcggctacaccttcacacggtataccatgcattgggtgaaacagagacccggacagtgtctggaatggatcggctacattaatcctagccgagggtacacaaactacaaccagaagtttaaagacaaggctactctgaccacagataagagctcctctaccgcatatatgcagctgagttcactgacatctgaggacagtgccgtgtactattgcgctaggtactatgacgatcactactccctggattattgggggcagggaactaccctgacagtgagctccgcagccgaacctaaatctagtgacaagactcatacctgcccaccttgtccagcaccagagctgctgggcgggccttctgtgttcctgtttccacccaaaccaaaggatactctgatgatctcccggacacctgaagtcacttgtgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggaaaggagtacaaatgcaaggtgagcaacaaggccctgcctgctccaatcgagaagacaattagcaaagccaagggccagccccgagaacctcaggtctacgtgctgcctccatctcgggacgagctgactaaaaaccaggtcagtctgctgtgtctggtgaagggattctatccaagcgatattgctgtggagtgggaatccaatggccagcccgaaaacaattacctgacttggccccctgtcctggactcagatggcagcttctttctgtatagtaaactgaccgtggacaagtcacggtggcagcaggggaacgtctttagctgttccgtgatgcatgaggccctgcacaatcattacacccagaaatctctgagtctgtcacccggcaag

SEQ ID NO: 457 - protein, 106 aa, Artificial Sequence; identical to SEQ ID NO: 235
  Description of Artificial Sequence: Synthetic polypeptide

SEQ ID NO: 458 - DNA, 318 bp, Artificial Sequence
  Description of Artificial Sequence: Synthetic polynucleotide
cagatcgtcctgacacagagcccagcaatcatgtcagccagccccggggagaaagtcacaatgacttgctcagcaagctcctctgtgagctacatgaactggtatcagcagaaaagcgggacctcccccaagagatggatctacgacacatccaagctggcttctggagtgcctgcacacttcaggggcagcggctctgggaccagttattcactgacaatttccggcatggaggctgaagatgccgctacctactattgccagcagtggagttcaaacccattcacttttggatgtggcaccaagctggaaattaat

SEQ ID NO: 459 - protein, 5 aa, Artificial Sequence
  Description of Artificial Sequence: Synthetic peptide
SSVSY

SEQ ID NO: 460 - DNA, 15 bp, Artificial Sequence
  Description of Artificial Sequence: Synthetic oligonucleotide
tcctctgtgagctac

SEQ ID NO: 461 - protein, 9 aa, Artificial Sequence
  Description of Artificial Sequence: Synthetic peptide
QQWSSNPFT

SEQ ID NO: 462 - DNA, 27 bp, Artificial Sequence
  Description of Artificial Sequence: Synthetic oligonucleotide
cagcagtggagttcaaacccattcact

SEQ ID NO: 463 - protein, 3 aa, Artificial Sequence
  Description of Artificial Sequence: Synthetic peptide
DTS

SEQ ID NO: 464 - DNA, 9 bp, Artificial Sequence
  Description of Artificial Sequence: Synthetic oligonucleotide
gacacatcc

SEQ ID NO: 465 - protein, 119 aa, Artificial Sequence; identical to SEQ ID NO: 265
  Description of Artificial Sequence: Synthetic polypeptide

SEQ ID NO: 466 - DNA, 357 bp, Artificial Sequence
  Description of Artificial Sequence: Synthetic polynucleotide
caggtgcagctgcagcagtccggagctgagctggcacgaccaggagcaagtgtgaaaatgtcatgcaaggccagcggctacaccttcacacggtataccatgcattgggtgaaacagagacccggacagtgtctggaatggatcggctacattaatcctagccgagggtacacaaactacaaccagaagtttaaagacaaggctactctgaccacagataagagctcctctaccgcatatatgcagctgagttcactgacatctgaggacagtgccgtgtactattgcgctaggtactatgacgatcactactccctggattattgggggcagggaactaccctgacagtgagctcc

SEQ ID NO: 467 - protein, 8 aa, Artificial Sequence
  Description of Artificial Sequence: Synthetic peptide
GYTFTRYT

SEQ ID NO: 468 - DNA, 24 bp, Artificial Sequence
  Description of Artificial Sequence: Synthetic oligonucleotide
ggctacaccttcacacggtatacc

SEQ ID NO: 469 - protein, 12 aa, Artificial Sequence
  Description of Artificial Sequence: Synthetic peptide
ARYYDDHYSLDY

SEQ ID NO: 470 - DNA, 36 bp, Artificial Sequence
  Description of Artificial Sequence: Synthetic oligonucleotide
gctaggtactatgacgatcactactccctggattat

SEQ ID NO: 471 - protein, 8 aa, Artificial Sequence
  Description of Artificial Sequence: Synthetic peptide
INPSRGYT

SEQ ID NO: 472 - DNA, 24 bp, Artificial Sequence
  Description of Artificial Sequence: Synthetic oligonucleotide
attaatcctagccgagggtacaca

SEQ ID NO: 473 - protein, 110 aa, Artificial Sequence; identical to SEQ ID NO: 147
  Description of Artificial Sequence: Synthetic polypeptide

SEQ ID NO: 474 - DNA, 330 bp, Artificial Sequence
  Description of Artificial Sequence: Synthetic polynucleotide
gcaccagagctgctgggcgggccttctgtgttcctgtttccacccaaaccaaaggatactctgatgatctcccggacacctgaagtcacttgtgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggaaaggagtacaaatgcaaggtgagcaacaaggccctgcctgctccaatcgagaagacaattagcaaagccaag

SEQ ID NO: 475 - protein, 106 aa, Artificial Sequence; identical to SEQ ID NO: 21
  Description of Artificial Sequence: Synthetic polypeptide

SEQ ID NO: 476 - DNA, 318 bp, Artificial Sequence; identical to SEQ ID NO: 454
  Description of Artificial Sequence: Synthetic polynucleotide

SEQ ID NO: 477 - protein, 484 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 478 - DNA, 1452 bp, Artificial Sequence
  Description of Artificial Sequence: Synthetic polynucleotide
gatattcagctgacacagagtcctgcatcactggctgtgagcctgggacagcgagcaactatctcctgcaaagccagtcagtcagtggactatgatggcgactcctatctgaactggtaccagcagatcccagggcagccccctaagctgctgatctacgacgcctcaaatctggtgagcggcatcccaccacgattcagcggcagcggctctgggactgattttaccctgaacattcacccagtcgagaaggtggacgccgctacctaccattgccagcagtctaccgaggacccctggacattcggcgggggaactaaactggaaatcaagggaggaggaggcagtggcggaggagggtcaggaggaggaggaagccaggtgcagctgcagcagagcggagcagagctggtcagaccaggaagctccgtgaaaatttcctgtaaggcttctggctatgcattttctagttactggatgaattgggtgaagcagaggccaggacagggcctggaatggatcgggcagatttggcccggggatggagacaccaactataatggaaagttcaaaggcaaggccacactgactgctgacgagtcaagctccacagcctatatgcagctgtctagtctggcaagcgaggattccgccgtgtacttttgcgctcggagagaaaccacaactgtgggcaggtactattacgctatggactactggggccaggggaccacagtcaccgtgtcaagcgcagccgaacccaaatcctctgataagacccacacatgccctccatgtccagctcctgaggctgcaggaggaccaagcgtgttcctgtttccccctaaacctaaggacacactgatgatctctcggacacccgaagtcacttgtgtggtcgtggatgtgagccacgaggaccctgaagtcaaattcaactggtacgtggatggcgtcgaggtgcataatgccaaaactaagcctagggaggaacagtataactccacttaccgcgtcgtgtctgtcctgaccgtgctgcatcaggactggctgaacggaaaggagtacaaatgcaaggtgagcaacaaggcactgccagcccccatcgagaagacaatttccaaagcaaagggccagcctcgagaaccacaggtctatgtgtacccacccagccgggacgagctgaccaaaaaccaggtctccctgacatgtctggtgaagggattttatccttctgatattgccgtggagtgggaaagtaatggccagccagaaaacaattacaagactacccctccagtgctggattctgacgggagtttcgctctggtcagtaaactgactgtggataagtcacggtggcagcagggaaacgtctttagttgttcagtgatgcacgaggcactgcacaatcattacacccagaaaagcctgtccctgtctcccggcaag

SEQ ID NO: 479 - protein, 111 aa, Artificial Sequence; identical to SEQ ID NO: 59
  Description of Artificial Sequence: Synthetic polypeptide

SEQ ID NO: 480 - DNA, 333 bp, Artificial Sequence; identical to SEQ ID NO: 72
  Description of Artificial Sequence: Synthetic polynucleotide

SEQ ID NO: 481 - protein, 10 aa, Artificial Sequence
  Description of Artificial Sequence: Synthetic peptide
QSVDYDGDSY

SEQ ID NO: 482 - DNA, 30 bp, Artificial Sequence; identical to SEQ ID NO: 74
  Description of Artificial Sequence: Synthetic oligonucleotide

SEQ ID NO: 483 - protein, 9 aa, Artificial Sequence
  Description of Artificial Sequence: Synthetic peptide
QQSTEDPWT

SEQ ID NO: 484 - DNA, 27 bp, Artificial Sequence
  Description of Artificial Sequence: Synthetic oligonucleotide
cagcagtctaccgaggacccctggaca

SEQ ID NO: 485 - protein, 3 aa, Artificial Sequence
  Description of Artificial Sequence: Synthetic peptide
DAS

SEQ ID NO: 486 - DNA, 9 bp, Artificial Sequence
  Description of Artificial Sequence: Synthetic oligonucleotide
gacgcctca

SEQ ID NO: 487 - protein, 124 aa, Artificial Sequence; identical to SEQ ID NO: 79
  Description of Artificial Sequence: Synthetic polypeptide

SEQ ID NO: 488 - DNA, 372 bp, Artificial Sequence; identical to SEQ ID NO: 80
  Description of Artificial Sequence: Synthetic polynucleotide

SEQ ID NO: 489 - protein, 8 aa, Artificial Sequence
  Description of Artificial Sequence: Synthetic peptide
GYAFSSYW

SEQ ID NO: 490 - DNA, 24 bp, Artificial Sequence
  Description of Artificial Sequence: Synthetic oligonucleotide
ggctatgcattttctagttactgg

SEQ ID NO: 491 - protein, 17 aa, Artificial Sequence
  Description of Artificial Sequence: Synthetic peptide
ARRETTTVGRYYYAMDY

SEQ ID NO: 492 - DNA, 51 bp, Artificial Sequence; identical to SEQ ID NO: 84
  Description of Artificial Sequence: Synthetic oligonucleotide

SEQ ID NO: 493 - protein, 8 aa, Artificial Sequence
  Description of Artificial Sequence: Synthetic peptide
IWPGDGDT

SEQ ID NO: 494 - DNA, 24 bp, Artificial Sequence
  Description of Artificial Sequence: Synthetic oligonucleotide
atttggcccggggatggagacacc

SEQ ID NO: 495 - protein, 110 aa, Artificial Sequence
  Description of Artificial Sequence: Synthetic polypeptide
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 496 - DNA, 330 bp, Artificial Sequence
  Description of Artificial Sequence: Synthetic polynucleotide
gctcctgaggctgcaggaggaccaagcgtgttcctgtttccccctaaacctaaggacacactgatgatctctcggacacccgaagtcacttgtgtggtcgtggatgtgagccacgaggaccctgaagtcaaattcaactggtacgtggatggcgtcgaggtgcataatgccaaaactaagcctagggaggaacagtataactccacttaccgcgtcgtgtctgtcctgaccgtgctgcatcaggactggctgaacggaaaggagtacaaatgcaaggtgagcaacaaggcactgccagcccccatcgagaagacaatttccaaagcaaag

SEQ ID NO: 497 - protein, 106 aa, Artificial Sequence; identical to SEQ ID NO: 89
  Description of Artificial Sequence: Synthetic polypeptide

SEQ ID NO: 498 - DNA, 318 bp, Artificial Sequence; identical to SEQ ID NO: 90
  Description of Artificial Sequence: Synthetic polynucleotide

SEQ ID NO: 499 - protein, 476 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKGRFTISTDKSKNTAYLQMDSLRAEDTGVYFCARYYDDHYSLDYWGQGTLVTVSSVEGGSGGSGGSGGSGGVDDIQMTQSPSSLSASVGDRVTITCSASSSVSYMNWYQQKPGKAPKRWIYDTSKLASGVPSRFSGSGSGTDYTLTISSLQPEDAATYYCQQWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 500 - DNA, 1428 bp, Artificial Sequence
  Description of Artificial Sequence: Synthetic polynucleotide
caggtgcagctggtgcagagcggaggaggagtggtgcagccaggccggtccctgagactgtcttgtaaggccagcggctacaccttcacaaggtataccatgcactgggtgcgccaggcaccaggcaagggactggagtggatcggctacatcaaccctagcaggggctacacaaactataatcagaaggtgaagggccgcttcaccatctccacagacaagtctaagaataccgcctacctgcagatggactccctgagggccgaggatacaggcgtgtatttttgcgcccgctactatgacgatcactacagcctggattattggggccagggcaccctggtgacagtgagctccgtggagggaggctccggaggctctggaggcagcggcggctccggcggcgtggacgatatccagatgacccagagcccttctagcctgtccgcctctgtgggcgacagggtgaccatcacatgtagcgcctcctctagcgtgtcctacatgaactggtatcagcagaagccaggcaaggcccccaagcggtggatctacgataccagcaagctggcctccggcgtgccatctagattcagcggctccggctctggcaccgactataccctgacaatctcctctctgcagcccgaggatgccgccacatactattgccagcagtggagctccaatcctttcacctttggccagggcacaaagctggagatcaaggccgccgagcccaagtctagcgacaagacccacacatgcccaccttgtccggcgccagaggcagcaggaggaccttccgtgttcctgtttccacccaagccaaaggataccctgatgatcagccgcacccctgaggtgacatgcgtggtggtgagcgtgtcccacgaggacccagaggtgaagtttaactggtacgtggatggcgtggaggtgcacaatgccaagacaaagcctcgggaggagcagtacaactctacctatagagtggtgagcgtgctgacagtgctgcaccaggactggctgaacggcaaggagtataagtgcaaggtgtccaataaggccctgcctgccccaatcgagaagaccatctctaaggccaagggccagcctcgcgaacctcaggtgtacgtgctgcctccatctagagacgagctgacaaagaaccaggtgagcctgctgtgcctggtgaagggcttctatccaagcgatatcgccgtggagtgggagtccaatggccagcccgagaacaattacctgacctggccccctgtgctggactctgatggcagcttctttctgtattccaagctgacagtggataagtctaggtggcagcagggcaacgtgttttcttgcagcgtgatgcacgaggccctgcacaatcactacacccagaagtccctgtctctgagccccggc

SEQ ID NO: 501 - protein, 119 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKGRFTISTDKSKNTAYLQMDSLRAEDTGVYFCARYYDDHYSLDYWGQGTLVTVSS

SEQ ID NO: 502 - DNA, 357 bp, Artificial Sequence
  Description of Artificial Sequence: Synthetic polynucleotide
caggtgcagctggtgcagagcggaggaggagtggtgcagccaggccggtccctgagactgtcttgtaaggccagcggctacaccttcacaaggtataccatgcactgggtgcgccaggcaccaggcaagggactggagtggatcggctacatcaaccctagcaggggctacacaaactataatcagaaggtgaagggccgcttcaccatctccacagacaagtctaagaataccgcctacctgcagatggactccctgagggccgaggatacaggcgtgtatttttgcgcccgctactatgacgatcactacagcctggattattggggccagggcaccctggtgacagtgagctcc

SEQ ID NO: 503 - protein, 8 aa, Artificial Sequence
  Description of Artificial Sequence: Synthetic peptide
GYTFTRYT

SEQ ID NO: 504 - DNA, 24 bp, Artificial Sequence
  Description of Artificial Sequence: Synthetic oligonucleotide
ggctacaccttcacaaggtatacc

SEQ ID NO: 505 - protein, 12 aa, Artificial Sequence
  Description of Artificial Sequence: Synthetic peptide
ARYYDDHYSLDY

SEQ ID NO: 506 - DNA, 36 bp, Artificial Sequence; identical to SEQ ID NO: 218
  Description of Artificial Sequence: Synthetic oligonucleotide

SEQ ID NO: 507 - protein, 8 aa, Artificial Sequence
  Description of Artificial Sequence: Synthetic peptide
INPSRGYT

SEQ ID NO: 508 - DNA, 24 bp, Artificial Sequence
  Description of Artificial Sequence: Synthetic oligonucleotide
atcaaccctagcaggggctacaca

SEQ ID NO: 509 - protein, 106 aa, Artificial Sequence
  Description of Artificial Sequence: Synthetic polypeptide
DIQMTQSPSSLSASVGDRVTITCSASSSVSYMNWYQQKPGKAPKRWIYDTSKLASGVPSRFSGSGSGTDYTLTISSLQPEDAATYYCQQWSSNPFTFGQGTKLEIK

SEQ ID NO: 510 - DNA, 318 bp, Artificial Sequence
  Description of Artificial Sequence: Synthetic polynucleotide
gatatccagatgacccagagcccttctagcctgtccgcctctgtgggcgacagggtgaccatcacatgtagcgcctcctctagcgtgtcctacatgaactggtatcagcagaagccaggcaaggcccccaagcggtggatctacgataccagcaagctggcctccggcgtgccatctagattcagcggctccggctctggcaccgactataccctgacaatctcctctctgcagcccgaggatgccgccacatactattgccagcagtggagctccaatcctttcacctttggccagggcacaaagctggagatcaag

SEQ ID NO: 511 - protein, 5 aa, Artificial Sequence
  Description of Artificial Sequence: Synthetic peptide
SSVSY

SEQ ID NO: 512 - DNA, 15 bp, Artificial Sequence
  Description of Artificial Sequence: Synthetic oligonucleotide
tctagcgtgtcctac

SEQ ID NO: 513 - protein, 9 aa, Artificial Sequence
  Description of Artificial Sequence: Synthetic peptide
QQWSSNPFT

SEQ ID NO: 514 - DNA, 27 bp, Artificial Sequence
  Description of Artificial Sequence: Synthetic oligonucleotide
cagcagtggagctccaatcctttcacc

SEQ ID NO: 515 - protein, 3 aa, Artificial Sequence
  Description of Artificial Sequence: Synthetic peptide
DTS

SEQ ID NO: 516 - DNA, 9 bp, Artificial Sequence
  Description of Artificial Sequence: Synthetic oligonucleotide
gataccagc

SEQ ID NO: 517 - protein, 110 aa, Artificial Sequence; identical to SEQ ID NO: 19
  Description of Artificial Sequence: Synthetic polypeptide

SEQ ID NO: 518 - DNA, 330 bp, Artificial Sequence
  Description of Artificial Sequence: Synthetic polynucleotide
gcgccagaggcagcaggaggaccttccgtgttcctgtttccacccaagccaaaggataccctgatgatcagccgcacccctgaggtgacatgcgtggtggtgagcgtgtcccacgaggacccagaggtgaagtttaactggtacgtggatggcgtggaggtgcacaatgccaagacaaagcctcgggaggagcagtacaactctacctatagagtggtgagcgtgctgacagtgctgcaccaggactggctgaacggcaaggagtataagtgcaaggtgtccaataaggccctgcctgccccaatcgagaagaccatctctaaggccaag

SEQ ID NO: 519 - protein, 106 aa, Artificial Sequence; identical to SEQ ID NO: 21
  Description of Artificial Sequence: Synthetic polypeptide

SEQ ID NO: 520 - DNA, 318 bp, Artificial Sequence; identical to SEQ ID NO: 232
  Description of Artificial Sequence: Synthetic polynucleotide

SEQ ID NO: 521 - protein, 476 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKGRFTISTDKSKNTAYLQMDSLRAEDTGVYFCARYYDDHYSLDYWGQGTLVTVSSVEGGSGGSGGSGGSGGVDDIQMTQSPSSLSASVGDRVTITCSASSSVSYMNWYQQKPGKAPKRLIYDTSKLASGVPSRFSGSGSGTDYTLTISSLQPEDAATYYCQQWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 522 - DNA, 1428 bp, Artificial Sequence
  Description of Artificial Sequence: Synthetic polynucleotide
caggtgcagctggtgcagagcggaggaggagtggtgcagccaggccggtccctgagactgtcttgtaaggccagcggctacaccttcacaaggtataccatgcactgggtgcgccaggcaccaggcaagggactggagtggatcggctacatcaaccctagcaggggctacacaaactataatcagaaggtgaagggccgcttcaccatctccacagacaagtctaagaataccgcctacctgcagatggactccctgagggccgaggatacaggcgtgtatttttgcgcccgctactatgacgatcactacagcctggattattggggccagggcaccctggtgacagtgagctccgtggagggaggctccggaggctctggaggcagcggcggctccggcggcgtggacgatatccagatgacccagagcccttctagcctgtccgcctctgtgggcgacagggtgaccatcacatgtagcgcctcctctagcgtgtcctacatgaactggtatcagcagaagccaggcaaggcccccaagcggctgatctacgataccagcaagctggcctccggcgtgccatctagattcagcggctccggctctggcaccgactataccctgacaatctcctctctgcagcccgaggatgccgccacatactattgccagcagtggagctccaatcctttcacctttggccagggcacaaagctggagatcaaggccgccgagcccaagtctagcgacaagacccacacatgcccaccttgtccggcgccagaggcagcaggaggaccttccgtgttcctgtttccacccaagccaaaggataccctgatgatcagccgcacccctgaggtgacatgcgtggtggtgagcgtgtcccacgaggacccagaggtgaagtttaactggtacgtggatggcgtggaggtgcacaatgccaagacaaagcctcgggaggagcagtacaactctacctatagagtggtgagcgtgctgacagtgctgcaccaggactggctgaacggcaaggagtataagtgcaaggtgtccaataaggccctgcctgccccaatcgagaagaccatctctaaggccaagggccagcctcgcgaacctcaggtgtacgtgctgcctccatctagagacgagctgacaaagaaccaggtgagcctgctgtgcctggtgaagggcttctatccaagcgatatcgccgtggagtgggagtccaatggccagcccgagaacaattacctgacctggccccctgtgctggactctgatggcagcttctttctgtattccaagctgacagtggataagtctaggtggcagcagggcaacgtgttttcttgcagcgtgatgcacgaggccctgcacaatcactacacccagaagtccctgtctctgagccccggc

SEQ ID NO: 523 - protein, 119 aa, Artificial Sequence; identical to SEQ ID NO: 501
  Description of Artificial Sequence: Synthetic polypeptide

SEQ ID NO: 524 - DNA, 357 bp, Artificial Sequence; identical to SEQ ID NO: 502
  Description of Artificial Sequence: Synthetic polynucleotide

SEQ ID NO: 525 - protein, 8 aa, Artificial Sequence
  Description of Artificial Sequence: Synthetic peptide
GYTFTRYT

SEQ ID NO: 526 - DNA, 24 bp, Artificial Sequence
  Description of Artificial Sequence: Synthetic oligonucleotide
ggctacaccttcacaaggtatacc

SEQ ID NO: 527 - protein, 12 aa, Artificial Sequence
  Description of Artificial Sequence: Synthetic peptide
ARYYDDHYSLDY

SEQ ID NO: 528 - DNA, 36 bp, Artificial Sequence; identical to SEQ ID NO: 218
  Description of Artificial Sequence: Synthetic oligonucleotide

SEQ ID NO: 529 - protein, 8 aa, Artificial Sequence
  Description of Artificial Sequence: Synthetic peptide
INPSRGYT

SEQ ID NO: 530 - DNA, 24 bp, Artificial Sequence
  Description of Artificial Sequence: Synthetic oligonucleotide
atcaaccctagcaggggctacaca

SEQ ID NO: 531 - protein, 106 aa, Artificial Sequence; identical to SEQ ID NO: 221
  Description of Artificial Sequence: Synthetic polypeptide

SEQ ID NO: 532 - DNA, 318 bp, Artificial Sequence; identical to SEQ ID NO: 222
  Description of Artificial Sequence: Synthetic polynucleotide

SEQ ID NO: 533 - protein, 5 aa, Artificial Sequence
  Description of Artificial Sequence: Synthetic peptide
SSVSY

SEQ ID NO: 534 - DNA, 15 bp, Artificial Sequence
  Description of Artificial Sequence: Synthetic oligonucleotide
tctagcgtgtcctac

SEQ ID NO: 535 - protein, 9 aa, Artificial Sequence
  Description of Artificial Sequence: Synthetic peptide
QQWSSNPFT

SEQ ID NO: 536 - DNA, 27 bp, Artificial Sequence
  Description of Artificial Sequence: Synthetic oligonucleotide
cagcagtggagctccaatcctttcacc

SEQ ID NO: 537 - protein, 3 aa, Artificial Sequence
  Description of Artificial Sequence: Synthetic peptide
DTS

SEQ ID NO: 538 - DNA, 9 bp, Artificial Sequence
  Description of Artificial Sequence: Synthetic oligonucleotide
gataccagc

SEQ ID NO: 539 - protein, 110 aa, Artificial Sequence; identical to SEQ ID NO: 19
  Description of Artificial Sequence: Synthetic polypeptide

SEQ ID NO: 540 - DNA, 330 bp, Artificial Sequence; identical to SEQ ID NO: 518
  Description of Artificial Sequence: Synthetic polynucleotide

SEQ ID NO: 541 - protein, 106 aa, Artificial Sequence; identical to SEQ ID NO: 21
  Description of Artificial Sequence: Synthetic polypeptide

SEQ ID NO: 542 - DNA, 318 bp, Artificial Sequence; identical to SEQ ID NO: 232
  Description of Artificial Sequence: Synthetic polynucleotide

SEQ ID NO: 543 - protein, 476 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYYDDHYSLDYWGQGTLVTVSSVEGGSGGSGGSGGSGGVDDIQMTQSPSSLSASVGDRVTITCSASSSVSYMNWYQQKPGKAPKRWIYDTSKLASGVPSRFSGSGSGTDYTLTISSLQPEDAATYYCQQWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 544 - DNA, 1428 bp, Artificial Sequence
  Description of Artificial Sequence: Synthetic polynucleotide
caggtgcagctggtgcagagcggaggaggagtggtgcagccaggccggtccctgagactgtcttgtaaggccagcggctacaccttcacaaggtataccatgcactgggtgcgccaggcaccaggcaagggactggagtggatcggctacatcaaccctagcaggggctacacaaactataatcagaaggtgaagggccgcttcaccatctccacagacaactctaagaataccgcctacctgcagatggactccctgagggccgaggatacaggcgtgtatttttgcgcccgctactatgacgatcactacagcctggattattggggccagggcaccctggtgacagtgagctccgtggagggaggctccggaggctctggaggcagcggcggctccggcggcgtggacgatatccagatgacccagagcccttctagcctgtccgcctctgtgggcgacagggtgaccatcacatgtagcgcctcctctagcgtgtcctacatgaactggtatcagcagaagccaggcaaggcccccaagcggtggatctacgataccagcaagctggcctccggcgtgccatctagattcagcggctccggctctggcaccgactataccctgacaatctcctctctgcagcccgaggatgccgccacatactattgccagcagtggagctccaatcctttcacctttggccagggcacaaagctggagatcaaggccgccgagcccaagtctagcgacaagacccacacatgcccaccttgtccggcgccagaggcagcaggaggaccttccgtgttcctgtttccacccaagccaaaggataccctgatgatcagccgcacccctgaggtgacatgcgtggtggtgagcgtgtcccacgaggacccagaggtgaagtttaactggtacgtggatggcgtggaggtgcacaatgccaagacaaagcctcgggaggagcagtacaattctacctatagagtggtgagcgtgctgacagtgctgcaccaggactggctgaacggcaaggagtataagtgcaaggtgtccaataaggccctgcctgccccaatcgagaagaccatctctaaggccaagggccagcctcgcgaacctcaggtgtacgtgctgcctccatctagagacgagctgacaaagaaccaggtgagcctgctgtgcctggtgaagggcttctatccaagcgatatcgccgtggagtgggagtccaatggccagcccgagaacaattacctgacctggccccctgtgctggactctgatggcagcttctttctgtattccaagctgacagtggataagtctaggtggcagcagggcaacgtgttttcttgcagcgtgatgcacgaggccctgcacaatcactacacccagaagtccctgtctctgagccccggc

SEQ ID NO: 545 - protein, 119 aa, Artificial Sequence; identical to SEQ ID NO: 213
  Description of Artificial Sequence: Synthetic polypeptide

SEQ ID NO: 546 - DNA, 357 bp, Artificial Sequence; identical to SEQ ID NO: 214
  Description of Artificial Sequence: Synthetic polynucleotide

SEQ ID NO: 547 - protein, 8 aa, Artificial Sequence
  Description of Artificial Sequence: Synthetic peptide
GYTFTRYT

SEQ ID NO: 548 - DNA, 24 bp, Artificial Sequence
  Description of Artificial Sequence: Synthetic oligonucleotide
ggctacaccttcacaaggtatacc

SEQ ID NO: 549 - protein, 12 aa, Artificial Sequence
  Description of Artificial Sequence: Synthetic peptide
ARYYDDHYSLDY

SEQ ID NO: 550 - DNA, 36 bp, Artificial Sequence; identical to SEQ ID NO: 218
  Description of Artificial Sequence: Synthetic oligonucleotide

SEQ ID NO: 551 - protein, 8 aa, Artificial Sequence
  Description of Artificial Sequence: Synthetic peptide
INPSRGYT

SEQ ID NO: 552 - DNA, 24 bp, Artificial Sequence
  Description of Artificial Sequence: Synthetic oligonucleotide
atcaaccctagcaggggctacaca

SEQ ID NO: 553 - protein, 106 aa, Artificial Sequence; identical to SEQ ID NO: 509
  Description of Artificial Sequence: Synthetic polypeptide

SEQ ID NO: 554 - DNA, 318 bp, Artificial Sequence; identical to SEQ ID NO: 510
  Description of Artificial Sequence: Synthetic polynucleotide

SEQ ID NO: 555 - protein, 5 aa, Artificial Sequence
  Description of Artificial Sequence: Synthetic peptide
SSVSY

SEQ ID NO: 556 - DNA, 15 bp, Artificial Sequence
  Description of Artificial Sequence: Synthetic oligonucleotide
tctagcgtgtcctac

SEQ ID NO: 557 - protein, 9 aa, Artificial Sequence
  Description of Artificial Sequence: Synthetic peptide
QQWSSNPFT

SEQ ID NO: 558 - DNA, 27 bp, Artificial Sequence
  Description of Artificial Sequence: Synthetic oligonucleotide
cagcagtggagctccaatcctttcacc

SEQ ID NO: 559 - protein, 3 aa, Artificial Sequence
  Description of Artificial Sequence: Synthetic peptide
DTS

SEQ ID NO: 560 - DNA, 9 bp, Artificial Sequence
  Description of Artificial Sequence: Synthetic oligonucleotide
gataccagc

SEQ ID NO: 561 - protein, 110 aa, Artificial Sequence; identical to SEQ ID NO: 19
  Description of Artificial Sequence: Synthetic polypeptide

SEQ ID NO: 562 - DNA, 330 bp, Artificial Sequence; identical to SEQ ID NO: 230
  Description of Artificial Sequence: Synthetic polynucleotide

SEQ ID NO: 563 - protein, 106 aa, Artificial Sequence; identical to SEQ ID NO: 21
  Description of Artificial Sequence: Synthetic polypeptide

SEQ ID NO: 564 - DNA, 318 bp, Artificial Sequence; identical to SEQ ID NO: 232
  Description of Artificial Sequence: Synthetic polynucleotide

SEQ ID NO: 565 - protein, 481 aa, Artificial Sequence
  Description of Artificial Sequence: Synthetic polypeptide
DIQLTQSPSSLSASVGDRATITCRASQSVDYEGDSYLNWYQQKPGKAPKLLIYDASNLVSGIPSRFSGSGSGTDFTLTISSVQPEDAATYYCQQSTEDPWTFGCGTKLEIKGGGGSGGGGSGGGGSQVQLVQSGAEVKKPGASVKISCKASGYAFSSYWMNWVRQAPGQCLEWIGQIWPGDGDTNYAQKFQGRATLTADESTSTAYMELSSLRSEDTAVYYCARRETTTVGRYYYAMDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 566 - DNA, 1443 bp, Artificial Sequence
  Description of Artificial Sequence: Synthetic polynucleotide
gatattcagctgacccagagcccaagctccctgtctgccagtgtgggggatagggctacaatcacttgccgcgcatcacagagcgtggactatgagggcgattcctatctgaactggtaccagcagaagccagggaaagcacccaagctgctgatctacgacgcctctaatctggtgagtggcattccctcaaggttctccggatctggcagtgggactgactttaccctgacaatctctagtgtgcagcccgaggatgccgctacctactattgccagcagtctacagaagacccttggactttcggatgtggcaccaaactggagattaagggaggaggaggcagtggcggaggagggtcaggaggaggaggaagccaggtccagctggtgcagagcggagcagaggtcaagaaacccggagccagcgtgaaaatttcctgcaaggcctctggctatgctttctcaagctactggatgaactgggtgaggcaggcaccaggacagtgtctggaatggatcggacagatttggcctggggacggagataccaattatgctcagaagtttcagggacgcgcaactctgaccgccgatgagtcaacaagcactgcatacatggagctgtcctctctgcgctccgaagacacagccgtgtactattgcgcacggagagaaaccacaactgtgggccgatactattacgcaatggattactggggccaggggaccacagtcactgtgagttcagagcctaaaagctccgacaagacccacacatgcccaccttgtccggcgccagaagcagccggagggcctagcgtgttcctgtttccacccaagccaaaagataccctgatgatcagccggactcctgaggtcacctgcgtggtcgtgtccgtgtctcacgaggacccagaagtcaaattcaactggtatgtggatggcgtcgaagtgcataatgctaagacaaaaccccgagaggaacagtataactccacctaccgggtcgtgtctgtcctgacagtgctgcatcaggactggctgaacggcaaggagtacaagtgcaaagtgagcaacaaggccctgcccgccccaatcgaaaagaccatttccaaggccaaagggcagcctcgcgaacctcaggtctacgtgtaccctccatctagggatgaactgacaaaaaaccaggtcagtctgacttgtctggtgaagggcttctacccaagcgacattgccgtggagtgggaatccaatggccagcccgagaacaattacaagactaccccccctgtgctggacagcgatgggtccttcgctctggtcagtaaactgacagtggataagtcaagatggcagcagggaaatgtctttagttgttcagtgatgcacgaggcactgcacaaccactacacccagaagtcactgtccctgtcacccggc

SEQ ID NO: 567 - protein, 111 aa, Artificial Sequence; identical to SEQ ID NO: 323
  Description of Artificial Sequence: Synthetic polypeptide

SEQ ID NO: 568 - DNA, 333 bp, Artificial Sequence
  Description of Artificial Sequence: Synthetic polynucleotide
gatattcagctgacccagagcccaagctccctgtctgccagtgtgggggatagggctacaatcacttgccgcgcatcacagagcgtggactatgagggcgattcctatctgaactggtaccagcagaagccagggaaagcacccaagctgctgatctacgacgcctctaatctggtgagtggcattccctcaaggttctccggatctggcagtgggactgactttaccctgacaatctctagtgtgcagcccgaggatgccgctacctactattgccagcagtctacagaagacccttggactttcggatgtggcaccaaactggagattaag

SEQ ID NO: 569 - protein, 10 aa, Artificial Sequence
  Description of Artificial Sequence: Synthetic peptide
QSVDYEGDSY

SEQ ID NO: 570 - DNA, 30 bp, Artificial Sequence
  Description of Artificial Sequence: Synthetic oligonucleotide
cagagcgtggactatgagggcgattcctat

SEQ ID NO: 571 - protein, 9 aa, Artificial Sequence
  Description of Artificial Sequence: Synthetic peptide
QQSTEDPWT

SEQ ID NO: 572 - DNA, 27 bp, Artificial Sequence
  Description of Artificial Sequence: Synthetic oligonucleotide
cagcagtctacagaagacccttggact

SEQ ID NO: 573 - protein, 3 aa, Artificial Sequence
  Description of Artificial Sequence: Synthetic peptide
DAS

SEQ ID NO: 574 - DNA, 9 bp, Artificial Sequence
  Description of Artificial Sequence: Synthetic oligonucleotide
gacgcctct

SEQ ID NO: 575 - protein, 124 aa, Artificial Sequence
  Description of Artificial Sequence: Synthetic polypeptide
QVQLVQSGAEVKKPGASVKISCKASGYAFSSYWMNWVRQAPGQCLEWIGQIWPGDGDTNYAQKFQGRATLTADESTSTAYMELSSLRSEDTAVYYCARRETTTVGRYYYAMDYWGQGTTVTVSS

SEQ ID NO: 576 - DNA, 372 bp, Artificial Sequence
  Description of Artificial Sequence: Synthetic polynucleotide
caggtccagctggtgcagagcggagcagaggtcaagaaacccggagccagcgtgaaaatttcctgcaaggcctctggctatgctttctcaagctactggatgaactgggtgaggcaggcaccaggacagtgtctggaatggatcggacagatttggcctggggacggagataccaattatgctcagaagtttcagggacgcgcaactctgaccgccgatgagtcaacaagcactgcatacatggagctgtcctctctgcgctccgaagacacagccgtgtactattgcgcacggagagaaaccacaactgtgggccgatactattacgcaatggattactggggccaggggaccacagtcactgtgagttca

SEQ ID NO: 577 - protein, 8 aa, Artificial Sequence
  Description of Artificial Sequence: Synthetic peptide
GYAFSSYW

SEQ ID NO: 578 - DNA, 24 bp, Artificial Sequence
  Description of Artificial Sequence: Synthetic oligonucleotide
ggctatgctttctcaagctactgg

SEQ ID NO: 579 - protein, 17 aa, Artificial Sequence
  Description of Artificial Sequence: Synthetic peptide
ARRETTTVGRYYYAMDY

SEQ ID NO: 580 - DNA, 51 bp, Artificial Sequence
  Description of Artificial Sequence: Synthetic oligonucleotide
gcacggagagaaaccacaactgtgggccgatactattacgcaatggattac

SEQ ID NO: 581 - protein, 8 aa, Artificial Sequence
  Description of Artificial Sequence: Synthetic peptide
IWPGDGDT

SEQ ID NO: 582 - DNA, 24 bp, Artificial Sequence
  Description of Artificial Sequence: Synthetic oligonucleotide
atttggcctggggacggagatacc

SEQ ID NO: 583 - protein, 110 aa, Artificial Sequence; identical to SEQ ID NO: 19
  Description of Artificial Sequence: Synthetic polypeptide

SEQ ID NO: 584 - DNA, 330 bp, Artificial Sequence
  Description of Artificial Sequence: Synthetic polynucleotide
gcgccagaagcagccggagggcctagcgtgttcctgtttccacccaagccaaaagataccctgatgatcagccggactcctgaggtcacctgcgtggtcgtgtccgtgtctcacgaggacccagaagtcaaattcaactggtatgtggatggcgtcgaagtgcataatgctaagacaaaaccccgagaggaacagtataactccacctaccgggtcgtgtctgtcctgacagtgctgcatcaggactggctgaacggcaaggagtacaagtgcaaagtgagcaacaaggccctgcccgccccaatcgaaaagaccatttccaaggccaaa

SEQ ID NO: 585 - protein, 106 aa, Artificial Sequence; identical to SEQ ID NO: 89
  Description of Artificial Sequence: Synthetic polypeptide

SEQ ID NO: 586 - DNA, 318 bp, Artificial Sequence
  Description of Artificial Sequence: Synthetic polynucleotide
gggcagcctcgcgaacctcaggtctacgtgtaccctccatctagggatgaactgacaaaaaaccaggtcagtctgacttgtctggtgaagggcttctacccaagcgacattgccgtggagtgggaatccaatggccagcccgagaacaattacaagactaccccccctgtgctggacagcgatgggtccttcgctctggtcagtaaactgacagtggataagtcaagatggcagcagggaaatgtctttagttgttcagtgatgcacgaggcactgcacaaccactacacccagaagtcactgtccctgtcacccggc

SEQ ID NO: 587 - protein, 453 aa, Artificial Sequence
  Description of Artificial Sequence: Synthetic polypeptide
QVQLVQSGAEVKKPGASVKISCKASGYAFSSYWMNWVRQAPGQCLEWIGQIWPGDGDTNYAQKFQGRATLTADESTSTAYMELSSLRSEDTAVYYCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 588 - DNA, 1359 bp, Artificial Sequence
  Description of Artificial Sequence: Synthetic polynucleotide
caggtccagctggtgcagagcggagcagaggtgaagaagccaggagccagcgtgaagatctcctgcaaggcctctggctatgccttcagctcctactggatgaactgggtgcggcaggcacctggacagtgtctggagtggatcggacagatctggccaggcgacggcgatacaaattatgcccagaagtttcagggcagagccacactgaccgccgacgagagcacatccaccgcctacatggagctgtctagcctgaggagcgaggataccgccgtgtactattgcgcaaggagagagaccacaaccgtgggccgctactattacgccatggactattggggccagggcacaaccgtgacagtgtcctctgctagcaccaagggaccttccgtgttcccactggcaccaagctccaagtctacaagcggaggaaccgccgccctgggatgtctggtgaaggattacttcccagagcccgtgaccgtgtcttggaacagcggggccctgaccagcggagtgcacacctttcctgccgtgctgcagtctagcggcctgtattccctgtcctctgtggtcacagtgccaagctcctctctgggcacacagacctacatctgcaacgtgaatcacaagccatccaataccaaggtcgacaagaaggtggagcccaagtcttgtgataagacacacacctgcccaccttgtccggcgccagaggcagcaggaggaccaagcgtgttcctgtttccacccaagcctaaggacacactgatgatctccaggacaccagaggtgacctgcgtggtggtgtccgtgtctcacgaggaccccgaggtgaagttcaactggtacgtggatggcgtggaggtgcacaatgccaagaccaagcccagggaggagcagtataactctacataccgcgtggtgagcgtgctgaccgtgctgcaccaggattggctgaacggcaaggagtacaagtgcaaggtgagcaataaggccctgcccgcccctatcgagaagaccatctccaaggccaagggccagcctcgcgaaccacaggtgtacgtgtaccctccatctagagacgagctgacaaagaaccaggtgagcctgacctgtctggtgaagggcttttatcccagcgatatcgccgtggagtgggagtccaatggccagcctgagaacaattacaagacaaccccccctgtgctggactccgatggctctttcgccctggtgtccaagctgaccgtggacaagtctcggtggcagcagggcaacgtgttcagctgttccgtgatgcacgaggcactgcacaatcactacacccagaagtcactgtcactgtccccaggc

SEQ ID NO: 589 - protein, 124 aa, Artificial Sequence; identical to SEQ ID NO: 575
  Description of Artificial Sequence: Synthetic polypeptide

SEQ ID NO: 590 - DNA, 372 bp, Artificial Sequence
  Description of Artificial Sequence: Synthetic polynucleotide
caggtccagctggtgcagagcggagcagaggtgaagaagccaggagccagcgtgaagatctcctgcaaggcctctggctatgccttcagctcctactggatgaactgggtgcggcaggcacctggacagtgtctggagtggatcggacagatctggccaggcgacggcgatacaaattatgcccagaagtttcagggcagagccacactgaccgccgacgagagcacatccaccgcctacatggagctgtctagcctgaggagcgaggataccgccgtgtactattgcgcaaggagagagaccacaaccgtgggccgctactattacgccatggactattggggccagggcacaaccgtgacagtgtcctct

SEQ ID NO: 591 - protein, 8 aa, Artificial Sequence
  Description of Artificial Sequence: Synthetic peptide
GYAFSSYW

SEQ ID NO: 592 - DNA, 24 bp, Artificial Sequence
  Description of Artificial Sequence: Synthetic oligonucleotide
ggctatgccttcagctcctactgg

SEQ ID NO: 593 - protein, 17 aa, Artificial Sequence
  Description of Artificial Sequence: Synthetic peptide
ARRETTTVGRYYYAMDY

SEQ ID NO: 594 - DNA, 51 bp, Artificial Sequence
  Description of Artificial Sequence: Synthetic oligonucleotide
gcaaggagagagaccacaaccgtgggccgctactattacgccatggactat

SEQ ID NO: 595 - protein, 8 aa, Artificial Sequence
  Description of Artificial Sequence: Synthetic peptide
IWPGDGDT

SEQ ID NO: 596 - DNA, 24 bp, Artificial Sequence
  Description of Artificial Sequence: Synthetic oligonucleotide
atctggccaggcgacggcgataca

SEQ ID NO: 597 - protein, 98 aa, Artificial Sequence; identical to SEQ ID NO: 145
  Description of Artificial Sequence: Synthetic polypeptide

SEQ ID NO: 598 - DNA, 294 bp, Artificial Sequence
  Description of Artificial Sequence: Synthetic polynucleotide
gctagcaccaagggaccttccgtgttcccactggcaccaagctccaagtctacaagcggaggaaccgccgccctgggatgtctggtgaaggattacttcccagagcccgtgaccgtgtcttggaacagcggggccctgaccagcggagtgcacacctttcctgccgtgctgcagtctagcggcctgtattccctgtcctctgtggtcacagtgccaagctcctctctgggcacacagacctacatctgcaacgtgaatcacaagccatccaataccaaggtcgacaagaaggtg

SEQ ID NO: 599 - protein, 110 aa, Artificial Sequence; identical to SEQ ID NO: 19
  Description of Artificial Sequence: Synthetic polypeptide

SEQ ID NO: 600 - DNA, 330 bp, Artificial Sequence
  Description of Artificial Sequence: Synthetic polynucleotide
gcgccagaggcagcaggaggaccaagcgtgttcctgtttccacccaagcctaaggacacactgatgatctccaggacaccagaggtgacctgcgtggtggtgtccgtgtctcacgaggaccccgaggtgaagttcaactggtacgtggatggcgtggaggtgcacaatgccaagaccaagcccagggaggagcagtataactctacataccgcgtggtgagcgtgctgaccgtgctgcaccaggattggctgaacggcaaggagtacaagtgcaaggtgagcaataaggccctgcccgcccctatcgagaagaccatctccaaggccaag

SEQ ID NO: 601 - protein, 106 aa, Artificial Sequence; identical to SEQ ID NO: 89
  Description of Artificial Sequence: Synthetic polypeptide

SEQ ID NO: 602 - DNA, 318 bp, Artificial Sequence
  Description of Artificial Sequence: Synthetic polynucleotide
ggccagcctcgcgaaccacaggtgtacgtgtaccctccatctagagacgagctgacaaagaaccaggtgagcctgacctgtctggtgaagggcttttatcccagcgatatcgccgtggagtgggagtccaatggccagcctgagaacaattacaagacaaccccccctgtgctggactccgatggctctttcgccctggtgtccaagctgaccgtggacaagtctcggtggcagcagggcaacgtgttcagctgttccgtgatgcacgaggcactgcacaatcactacacccagaagtcactgtcactgtccccaggc

SEQ ID NO: 603 - protein, 218 aa, Artificial Sequence; identical to SEQ ID NO: 321
  Description of Artificial Sequence: Synthetic polypeptide

SEQ ID NO: 604 - DNA, 654 bp, Artificial Sequence
  Description of Artificial Sequence: Synthetic polynucleotide
gatattcagctgacccagtctccaagctccctgagcgcctccgtgggcgatagggccaccatcacatgcagagcctctcagagcgtggactacgagggcgattcctacctgaactggtatcagcagaagccaggcaaggcccccaagctgctgatctatgacgcctccaatctggtgtctggcatccccagccggttctccggctctggcagcggaacagactttaccctgacaatctctagcgtgcagcctgaggatgccgccacctactattgccagcagagcaccgaggacccatggacattcggctgtggcaccaagctggagatcaagaggacagtggcggcgcccagcgtgttcatctttcccccttccgatgagcagctgaagtccggcaccgcctctgtggtgtgcctgctgaacaacttctacccccgggaggccaaggtgcagtggaaggtggacaacgccctgcagtccggcaattctcaggagagcgtgacagagcaggactccaaggattctacctatagcctgtcctctaccctgacactgtccaaggccgattacgagaagcacaaggtgtatgcctgtgaggtcacccaccaggggctgtcatcaccagtcaccaaatcattcaataggggcgagtgc

SEQ ID NO: 605 - protein, 111 aa, Artificial Sequence; identical to SEQ ID NO: 323
  Description of Artificial Sequence: Synthetic polypeptide

SEQ ID NO: 606 - DNA, 333 bp, Artificial Sequence
  Description of Artificial Sequence: Synthetic polynucleotide
gatattcagctgacccagtctccaagctccctgagcgcctccgtgggcgatagggccaccatcacatgcagagcctctcagagcgtggactacgagggcgattcctacctgaactggtatcagcagaagccaggcaaggcccccaagctgctgatctatgacgcctccaatctggtgtctggcatccccagccggttctccggctctggcagcggaacagactttaccctgacaatctctagcgtgcagcctgaggatgccgccacctactattgccagcagagcaccgaggacccatggacattcggctgtggcaccaagctggagatcaag

SEQ ID NO: 607 - protein, 10 aa, Artificial Sequence
  Description of Artificial Sequence: Synthetic peptide
QSVDYEGDSY

SEQ ID NO: 608 - DNA, 30 bp, Artificial Sequence
  Description of Artificial Sequence: Synthetic oligonucleotide
cagagcgtggactacgagggcgattcctac

SEQ ID NO: 609 - protein, 9 aa, Artificial Sequence
  Description of Artificial Sequence: Synthetic peptide
QQSTEDPWT

SEQ ID NO: 610 - DNA, 27 bp, Artificial Sequence
  Description of Artificial Sequence: Synthetic oligonucleotide
cagcagagcaccgaggacccatggaca

SEQ ID NO: 611 - protein, 3 aa, Artificial Sequence
  Description of Artificial Sequence: Synthetic peptide
DAS

SEQ ID NO: 612 - DNA, 9 bp, Artificial Sequence
  Description of Artificial Sequence: Synthetic oligonucleotide
gacgcctcc

SEQ ID NO: 613 - protein, 107 aa, Artificial Sequence [sequence omitted]

SEQ ID NO: 614 - DNA, 321 bp, Artificial Sequence
  Description of Artificial Sequence: Synthetic polynucleotide
aggacagtggcggcgcccagcgtgttcatctttcccccttccgatgagcagctgaagtccggcaccgcctctgtggtgtgcctgctgaacaacttctacccccgggaggccaaggtgcagtggaaggtggacaacgccctgcagtccggcaattctcaggagagcgtgacagagcaggactccaaggattctacctatagcctgtcctctaccctgacactgtccaaggccgattacgagaagcacaaggtgtatgcctgtgaggtcacccaccaggggctgtcatcaccagtcaccaaatcattcaataggggcgagtgc

SEQ ID NO: 615 - protein, 448 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 616 - DNA, 1344 bp, Artificial Sequence
  Description of Artificial Sequence: Synthetic polynucleotide
caggtccagctggtccagtccggaggaggagtggtccagccaggacggtcactgagactgagctgcaaggcttccgggtacactttcacccgatataccatgcactgggtgcggcaggcaccagggaaaggactggaatggatcgggtacattaaccctagcaggggatacacaaactataatcagaaggtgaaagacaggttcactatctctcgcgataacagtaagaataccgcctttctgcagatggacagcctgcgccccgaggatacaggcgtgtatttctgcgctcgatactatgacgatcactactgtctggactattggggccaggggactccagtcaccgtgagctccgcatcaactaagggacccagcgtgtttccactggccccctctagtaaatccacatctggaggaactgcagctctgggatgcctggtgaaggattacttcccagagcccgtcaccgtgagctggaactccggagccctgacttccggcgtccatacctttcccgctgtgctgcagtcaagcgggctgtactctctgtcctctgtggtcacagtgcctagttcaagcctgggaacacagacttatatctgcaacgtgaatcacaagcctagcaatactaaagtcgacaagaaagtggaaccaaagagctgtgataaaacccatacatgccccccttgtcctgcaccagaggcagcaggaggaccaagcgtgttcctgtttccacccaagcctaaagacaccctgatgattagccggacccctgaagtgacatgtgtggtcgtgagtgtgtcacacgaggacccagaagtcaagttcaactggtacgtggatggcgtcgaggtgcataatgccaagacaaaacctagagaggaacagtacaattccacctatagggtcgtgtctgtcctgacagtgctgcaccaggattggctgaacgggaaagagtataagtgcaaagtgtccaataaggctctgcccgcacctatcgagaaaaccatttctaaggctaaaggccagcctagggaaccacaggtctacgtgtatcctccatctcgcgacgagctgacaaagaaccaggtcagtctgacttgtctggtgaaaggattttacccaagcgatattgccgtggagtgggaatccaatggccagcccgaaaacaattataagaccacaccccctgtgctggactctgatggcagtttcgcactggtcagtaagctgactgtggacaaatcaagatggcagcaggggaacgtctttagctgttccgtgatgcatgaggccctgcacaatcattacacccagaagtctctgagtctgtcacccggc

SEQ ID NO: 617 - protein, 119 aa, Artificial Sequence [sequence omitted]

SEQ ID NO: 618 - DNA, 357 bp, Artificial Sequence
  Description of Artificial Sequence: Synthetic polynucleotide
caggtccagctggtccagtccggaggaggagtggtccagccaggacggtcactgagactgagctgcaaggcttccgggtacactttcacccgatataccatgcactgggtgcggcaggcaccagggaaaggactggaatggatcgggtacattaaccctagcaggggatacacaaactataatcagaaggtgaaagacaggttcactatctctcgcgataacagtaagaataccgcctttctgcagatggacagcctgcgccccgaggatacaggcgtgtatttctgcgctcgatactatgacgatcactactgtctggactattggggccaggggactccagtcaccgtgagctcc

SEQ ID NO: 619 - protein, 8 aa, Artificial Sequence
  Description of Artificial Sequence: Synthetic peptide
GYTFTRYT

SEQ ID NO: 620 - DNA, 24 bp, Artificial Sequence
  Description of Artificial Sequence: Synthetic oligonucleotide
gggtacactttcacccgatatacc

SEQ ID NO: 621 - protein, 12 aa, Artificial Sequence
  Description of Artificial Sequence: Synthetic peptide
ARYYDDHYCLDY

SEQ ID NO: 622 - DNA, 36 bp, Artificial Sequence
  Description of Artificial Sequence: Synthetic oligonucleotide
gctcgatactatgacgatcactactgtctggactat

SEQ ID NO: 623 - protein, 8 aa, Artificial Sequence
  Description of Artificial Sequence: Synthetic peptide
INPSRGYT

SEQ ID NO: 624 - DNA, 24 bp, Artificial Sequence
  Description of Artificial Sequence: Synthetic oligonucleotide
attaaccctagcaggggatacaca

SEQ ID NO: 625 - protein, 98 aa, Artificial Sequence; identical to SEQ ID NO: 145
  Description of Artificial Sequence: Synthetic polypeptide

SEQ ID NO: 626 - DNA, 294 bp, Artificial Sequence
  Description of Artificial Sequence: Synthetic polynucleotide
gcatcaactaagggacccagcgtgtttccactggccccctctagtaaatccacatctggaggaactgcagctctgggatgcctggtgaaggattacttcccagagcccgtcaccgtgagctggaactccggagccctgacttccggcgtccatacctttcccgctgtgctgcagtcaagcgggctgtactctctgtcctctgtggtcacagtgcctagttcaagcctgggaacacagacttatatctgcaacgtgaatcacaagcctagcaatactaaagtcgacaagaaagtg

SEQ ID NO: 627 - protein, 110 aa, Artificial Sequence; identical to SEQ ID NO: 19
  Description of Artificial Sequence: Synthetic polypeptide

SEQ ID NO: 628 - DNA, 330 bp, Artificial Sequence
  Description of Artificial Sequence: Synthetic polynucleotide
gcaccagaggcagcaggaggaccaagcgtgttcctgtttccacccaagcctaaagacaccctgatgattagccggacccctgaagtgacatgtgtggtcgtgagtgtgtcacacgaggacccagaagtcaagttcaactggtacgtggatggcgtcgaggtgcataatgccaagacaaaacctagagaggaacagtacaattccacctatagggtcgtgtctgtcctgacagtgctgcaccaggattggctgaacgggaaagagtataagtgcaaagtgtccaataaggctctgcccgcacctatcgagaaaaccatttctaaggctaaa

SEQ ID NO: 629 - protein, 106 aa, Artificial Sequence; identical to SEQ ID NO: 89
  Description of Artificial Sequence: Synthetic polypeptide

SEQ ID NO: 630 - DNA, 318 bp, Artificial Sequence
  Description of Artificial Sequence: Synthetic polynucleotide
ggccagcctagggaaccacaggtctacgtgtatcctccatctcgcgacgagctgacaaagaaccaggtcagtctgacttgtctggtgaaaggattttacccaagcgatattgccgtggagtgggaatccaatggccagcccgaaaacaattataagaccacaccccctgtgctggactctgatggcagtttcgcactggtcagtaagctgactgtggacaaatcaagatggcagcaggggaacgtctttagctgttccgtgatgcatgaggccctgcacaatcattacacccagaagtctctgagtctgtcacccggc

SEQ ID NO: 631 - protein, 449 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 632 - DNA, 1347 bp, Artificial Sequence
  Description of Artificial Sequence: Synthetic polynucleotide
caggtccagctggtgcagagcggaggaggagtggtccagccaggacggtctctgagactgagttgcaaggcatcagggtacactttcacccgatataccatgcactgggtgcggcaggcaccagggaaaggactggaatggatcgggtacattaacccttccaggggatacacaaactataatcagaaggtgaaagacaggttcactatcagccgcgataactccaagaataccgcttttctgcagatggactctctgcgccccgaggatacaggcgtgtatttctgcgcacgatactatgacgatcactactgtctggactattggggccaggggactccagtcaccgtgagctccgcctctactaagggacccagtgtgtttccactggctccctctagtaaatccacatctggaggaactgcagctctgggatgcctggtgaaggattacttcccagagcccgtcaccgtgagttggaactcaggagctctgactagcggcgtccatacctttcccgcagtgctgcagtcaagcgggctgtacagcctgtcctctgtggtcacagtgcctagttcaagcctgggaacacagacttatatctgcaacgtgaatcacaagccttctaatactaaagtcgacaagaaagtggaaccaaagagttgtgataaaacccatacatgcccaccttgtcctgcaccagagctgctgggaggaccaagcgtgttcctgtttccacccaagcctaaagacaccctgatgattagccggacccctgaagtcacatgtgtggtcgtggacgtgagccacgaggaccccgaagtcaagttcaactggtacgtggatggcgtcgaggtgcataatgccaagacaaaacctagagaggaacagtacaattcaacctatagggtcgtgagcgtcctgacagtgctgcaccaggactggctgaacgggaaggagtataagtgcaaagtgtccaataaggcactgcccgcccctatcgagaaaaccatttctaaggcaaaaggccagcctagggaaccacaggtctacgtgtatcctccaagccgcgacgagctgacaaagaaccaggtctccctgacttgtctggtgaaaggattttacccaagtgatattgctgtggagtgggaatcaaatggccagcccgaaaacaattataagaccacaccccctgtgctggacagcgatggctccttcgccctggtctccaagctgactgtggataaatctagatggcagcaggggaacgtctttagttgttcagtgatgcatgaggctctgcacaatcattacacccagaagagcctgtccctgtctcccggcaaa

SEQ ID NO: 633 - protein, 119 aa, Artificial Sequence [sequence omitted]

SEQ ID NO: 634 - DNA, 357 bp, Artificial Sequence
  Description of Artificial Sequence: Synthetic polynucleotide
caggtccagctggtgcagagcggaggaggagtggtccagccaggacggtctctgagactgagttgcaaggcatcagggtacactttcacccgatataccatgcactgggtgcggcaggcaccagggaaaggactggaatggatcgggtacattaacccttccaggggatacacaaactataatcagaaggtgaaagacaggttcactatcagccgcgataactccaagaataccgcttttctgcagatggactctctgcgccccgaggatacaggcgtgtatttctgcgcacgatactatgacgatcactactgtctggactattggggccaggggactccagtcaccgtgagctcc

SEQ ID NO: 635 - protein, 8 aa, Artificial Sequence
  Description of Artificial Sequence: Synthetic peptide
GYTFTRYT

SEQ ID NO: 636 - DNA, 24 bp, Artificial Sequence
  Description of Artificial Sequence: Synthetic oligonucleotide
gggtacactttcacccgatatacc

SEQ ID NO: 637 - protein, 12 aa, Artificial Sequence
  Description of Artificial Sequence: Synthetic peptide
ARYYDDHYCLDY

SEQ ID NO: 638 - DNA, 36 bp, Artificial Sequence
  Description of Artificial Sequence: Synthetic oligonucleotide
gcacgatactatgacgatcactactgtctggactat

SEQ ID NO: 639 - protein, 8 aa, Artificial Sequence
  Description of Artificial Sequence: Synthetic peptide
INPSRGYT

SEQ ID NO: 640 - DNA, 24 bp, Artificial Sequence
  Description of Artificial Sequence: Synthetic oligonucleotide
attaacccttccaggggatacaca

SEQ ID NO: 641 - protein, 98 aa, Artificial Sequence; identical to SEQ ID NO: 145
  Description of Artificial Sequence: Synthetic polypeptide

SEQ ID NO: 642 - DNA, 294 bp, Artificial Sequence
  Description of Artificial Sequence: Synthetic polynucleotide
gcctctactaagggacccagtgtgtttccactggctccctctagtaaatccacatctggaggaactgcagctctgggatgcctggtgaaggattacttcccagagcccgtcaccgtgagttggaactcaggagctctgactagcggcgtccatacctttcccgcagtgctgcagtcaagcgggctgtacagcctgtcctctgtggtcacagtgcctagttcaagcctgggaacacagacttatatctgcaacgtgaatcacaagccttctaatactaaagtcgacaagaaagtg

SEQ ID NO: 643 - protein, 110 aa, Artificial Sequence; identical to SEQ ID NO: 147
  Description of Artificial Sequence: Synthetic polypeptide

SEQ ID NO: 644 - DNA, 330 bp, Artificial Sequence
  Description of Artificial Sequence: Synthetic polynucleotide
gcaccagagctgctgggaggaccaagcgtgttcctgtttccacccaagcctaaagacaccctgatgattagccggacccctgaagtcacatgtgtggtcgtggacgtgagccacgaggaccccgaagtcaagttcaactggtacgtggatggcgtcgaggtgcataatgccaagacaaaacctagagaggaacagtacaattcaacctatagggtcgtgagcgtcctgacagtgctgcaccaggactggctgaacgggaaggagtataagtgcaaagtgtccaataaggcactgcccgcccctatcgagaaaaccatttctaaggcaaaa

SEQ ID NO: 645 - protein, 106 aa, Artificial Sequence; identical to SEQ ID NO: 89
  Description of Artificial Sequence: Synthetic polypeptide

SEQ ID NO: 646 - DNA, 318 bp, Artificial Sequence
  Description of Artificial Sequence: Synthetic polynucleotide
ggccagcctagggaaccacaggtctacgtgtatcctccaagccgcgacgagctgacaaagaaccaggtctccctgacttgtctggtgaaaggattttacccaagtgatattgctgtggagtgggaatcaaatggccagcccgaaaacaattataagaccacaccccctgtgctggacagcgatggctccttcgccctggtctccaagctgactgtggataaatctagatggcagcaggggaacgtctttagttgttcagtgatgcatgaggctctgcacaatcattacacccagaagagcctgtccctgtctcccggc

SEQ ID NO: 647 - protein, 449 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 648 - DNA, 1347 bp, Artificial Sequence
  Description of Artificial Sequence: Synthetic polynucleotide
caggtccagctgaagcagagcggaccaggactggtgcagccttcacagagcctgtccatcacctgcacagtgtccggattctctctgactaactacggagtccactgggtgcgacagagtccaggaaaaggcctggagtggctgggcgtgatctggagcggagggaacaccgactataataccccttttacaagtcggctgtcaattaacaaggataactctaagagtcaggtgttctttaagatgaacagcctgcagtccaatgacaccgctatctactattgcgctagagcactgacatactatgattacgagttcgcatattgggggcagggaactctggtcaccgtgtctgccgctagtacaaagggaccaagcgtgtttccactggcaccaagctccaaatcaacaagcggaggcactgcagccctgggatgtctggtgaaggactacttcccagagcccgtcactgtgtcatggaacagcggcgcactgacttccggggtccatacctttcctgccgtgctgcagtctagtggcctgtactctctgtcaagcgtggtcacagtgccatcctctagtctggggactcagacctatatctgcaacgtgaatcacaagccttccaatactaaagtcgacaagaaagtggaaccaaagtcttgtgataaaacacatacttgccccccttgtcctgcaccagagctgctggggggaccatccgtgttcctgtttccacccaagcccaaagacaccctgatgatttcccgcaccccagaagtcacatgcgtggtcgtggacgtgtctcacgaggaccccgaagtcaagttcaactggtacgtggatggcgtcgaggtgcataatgctaagacaaaaccacgggaggaacagtacaatagtacatatagagtcgtgtcagtgctgaccgtcctgcaccaggactggctgaacggcaaggagtataagtgcaaagtgagcaataaggccctgcccgctcctatcgagaaaaccattagcaaggccaaagggcagcctagggaaccacaggtctacgtgctgcctccatcacgcgacgagctgacaaagaaccaggtcagcctgctgtgtctggtgaaagggttctatccctctgatatcgctgtggagtgggaaagtaatggacagcctgaaaacaattacctgacttggccccctgtgctggactccgatggatctttctttctgtatagcaagctgaccgtggataaatccaggtggcagcagggcaacgtcttttcctgttctgtgatgcatgaggccctgcacaatcattacacccagaagagtctgtcactgagccctggcaaa

SEQ ID NO: 649 - protein, 119 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 650 - DNA, 357 bp, Artificial Sequence
  Description of Artificial Sequence: Synthetic polynucleotide
caggtccagctgaagcagagcggaccaggactggtgcagccttcacagagcctgtccatcacctgcacagtgtccggattctctctgactaactacggagtccactgggtgcgacagagtccaggaaaaggcctggagtggctgggcgtgatctggagcggagggaacaccgactataataccccttttacaagtcggctgtcaattaacaaggataactctaagagtcaggtgttctttaagatgaacagcctgcagtccaatgacaccgctatctactattgcgctagagcactgacatactatgattacgagttcgcatattgggggcagggaactctggtcaccgtgtctgcc

SEQ ID NO: 651 - protein, 8 aa, Artificial Sequence
  Description of Artificial Sequence: Synthetic peptide
GFSLTNYG

SEQ ID NO: 652 - DNA, 24 bp, Artificial Sequence
  Description of Artificial Sequence: Synthetic oligonucleotide
ggattctctctgactaactacgga

SEQ ID NO: 653 - protein, 13 aa, Artificial Sequence
  Description of Artificial Sequence: Synthetic peptide
ARALTYYDYEFAY

SEQ ID NO: 654 - DNA, 39 bp, Artificial Sequence
  Description of Artificial Sequence: Synthetic oligonucleotide
gctagagcactgacatactatgattacgagttcgcatat

SEQ ID NO: 655 - protein, 7 aa, Artificial Sequence
  Description of Artificial Sequence: Synthetic peptide
IWSGGNT

SEQ ID NO: 656 - DNA, 21 bp, Artificial Sequence
  Description of Artificial Sequence: Synthetic oligonucleotide
atctggagcggagggaacacc

SEQ ID NO: 657 - protein, 98 aa, Artificial Sequence; identical to SEQ ID NO: 145
  Description of Artificial Sequence: Synthetic polypeptide

SEQ ID NO: 658 - DNA, 294 bp, Artificial Sequence
  Description of Artificial Sequence: Synthetic polynucleotide
gctagtacaaagggaccaagcgtgtttccactggcaccaagctccaaatcaacaagcggaggcactgcagccctgggatgtctggtgaaggactacttcccagagcccgtcactgtgtcatggaacagcggcgcactgacttccggggtccatacctttcctgccgtgctgcagtctagtggcctgtactctctgtcaagcgtggtcacagtgccatcctctagtctggggactcagacctatatctgcaacgtgaatcacaagccttccaatactaaagtcgacaagaaagtg

SEQ ID NO: 659 - protein, 110 aa, Artificial Sequence; identical to SEQ ID NO: 147
  Description of Artificial Sequence: Synthetic polypeptide

SEQ ID NO: 660 - DNA, 330 bp, Artificial Sequence
  Description of Artificial Sequence: Synthetic polynucleotide
gcaccagagctgctggggggaccatccgtgttcctgtttccacccaagcccaaagacaccctgatgatttcccgcaccccagaagtcacatgcgtggtcgtggacgtgtctcacgaggaccccgaagtcaagttcaactggtacgtggatggcgtcgaggtgcataatgctaagacaaaaccacgggaggaacagtacaatagtacatatagagtcgtgtcagtgctgaccgtcctgcaccaggactggctgaacggcaaggagtataagtgcaaagtgagcaataaggccctgcccgctcctatcgagaaaaccattagcaaggccaaa

SEQ ID NO: 661 - protein, 106 aa, Artificial Sequence; identical to SEQ ID NO: 21
  Description of Artificial Sequence: Synthetic polypeptide

SEQ ID NO: 662 - DNA, 318 bp, Artificial Sequence
  Description of Artificial Sequence: Synthetic polynucleotide
gggcagcctagggaaccacaggtctacgtgctgcctccatcacgcgacgagctgacaaagaaccaggtcagcctgctgtgtctggtgaaagggttctatccctctgatatcgctgtggagtgggaaagtaatggacagcctgaaaacaattacctgacttggccccctgtgctggactccgatggatctttctttctgtatagcaagctgaccgtggataaatccaggtggcagcagggcaacgtcttttcctgttctgtgatgcatgaggccctgcacaatcattacacccagaagagtctgtcactgagccctggc

SEQ ID NO: 663 - protein, 450 aa, Artificial Sequence
  Description of Artificial Sequence: Synthetic polypeptide
QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 664 - DNA, 1350 bp, Artificial Sequence
  Description of Artificial Sequence: Synthetic polynucleotide
caggtccagctggtccagagcggcgccgaagtgaagaaacccggggcttctgtcaaggtgagttgcaaagcttcaggctacacattccgaagctcctatatcagctgggtgcggcaggcaccaggacagggactggagtggatgggctggatctacgctggcacagggagtccctcatataaccagaagctgcaggggcgggtgactatgaccacagacactagcacctccacagcatacatggaactgaggtccctgcgctctgacgataccgctgtgtactattgcgcacggcacagagattactattctaatagtctgacctattggggacagggcaccctggtcacagtgtctagtgctagcacaaaggggccttccgtgtttccactggcaccctcaagcaaatcaactagcggaggaaccgcagctctgggatgtctggtgaaggactacttcccagagcccgtcacagtgagttggaactcaggggcactgaccagcggagtccatacatttcctgccgtgctgcagtcctctgggctgtactccctgagttcagtggtcacagtgccaagctcctctctgggaactcagacctatatctgcaacgtgaatcacaagccatccaatactaaagtcgacaagaaagtggaacccaagtcttgtgataaaacacatacttgcccaccttgtcctgcaccagagctgctgggaggaccatccgtgttcctgtttccacccaagcctaaagacactctgatgattagcaggacacccgaagtcacttgcgtggtcgtggacgtgagccacgaggaccccgaagtcaagttcaactggtacgtggatggcgtcgaggtgcataatgctaagaccaaacccagagaggaacagtacaactctacttatagggtcgtgagtgtcctgaccgtgctgcaccaggactggctgaacggcaaggagtataagtgcaaagtgtccaataaggcactgcccgcccctatcgagaaaaccatttctaaggcaaaagggcagcctcgcgaaccacaggtctacgtgctgcctccaagtcgagacgagctgacaaagaaccaggtcagcctgctgtgtctggtgaaaggattctatccttccgatatcgccgtggagtgggaatctaatggccagccagagaacaattacctgacttggccccctgtgctggacagcgatggcagcttcttcctgtattcaaagctgaccgtggataaaagccggtggcagcagggcaacgtcttttcctgttctgtgatgcatgaagccctgcacaatcattacacccagaagagtctgtcactgagccccggcaaa

SEQ ID NO: 665 - protein, 120 aa, Artificial Sequence
  Description of Artificial Sequence: Synthetic polypeptide
QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLTYWGQGTLVTVSS

SEQ ID NO: 666 - DNA, 360 bp, Artificial Sequence
  Description of Artificial Sequence: Synthetic polynucleotide
caggtccagctggtccagagcggcgccgaagtgaagaaacccggggcttctgtcaaggtgagttgcaaagcttcaggctacacattccgaagctcctatatcagctgggtgcggcaggcaccaggacagggactggagtggatgggctggatctacgctggcacagggagtccctcatataaccagaagctgcaggggcgggtgactatgaccacagacactagcacctccacagcatacatggaactgaggtccctgcgctctgacgataccgctgtgtactattgcgcacggcacagagattactattctaatagtctgacctattggggacagggcaccctggtcacagtgtctagt

SEQ ID NO: 667 - protein, 8 aa, Artificial Sequence
  Description of Artificial Sequence: Synthetic peptide
GYTFRSSY

SEQ ID NO: 668 - DNA, 24 bp, Artificial Sequence
  Description of Artificial Sequence: Synthetic oligonucleotide
ggctacacattccgaagctcctat

SEQ ID NO: 669 - protein, 13 aa, Artificial Sequence
  Description of Artificial Sequence: Synthetic peptide
ARHRDYYSNSLTY

SEQ ID NO: 670 - DNA, 39 bp, Artificial Sequence
  Description of Artificial Sequence: Synthetic oligonucleotide
gcacggcacagagattactattctaatagtctgacctat

SEQ ID NO: 671 - protein, 8 aa, Artificial Sequence
  Description of Artificial Sequence: Synthetic peptide
IYAGTGSP

SEQ ID NO: 672 - DNA, 24 bp, Artificial Sequence
  Description of Artificial Sequence: Synthetic oligonucleotide
atctacgctggcacagggagtccc

SEQ ID NO: 673 - protein, 98 aa, Artificial Sequence; identical to SEQ ID NO: 145
  Description of Artificial Sequence: Synthetic polypeptide

SEQ ID NO: 674 - DNA, 294 bp, Artificial Sequence
  Description of Artificial Sequence: Synthetic polynucleotide
gctagcacaaaggggccttccgtgtttccactggcaccctcaagcaaatcaactagcggaggaaccgcagctctgggatgtctggtgaaggactacttcccagagcccgtcacagtgagttggaactcaggggcactgaccagcggagtccatacatttcctgccgtgctgcagtcctctgggctgtactccctgagttcagtggtcacagtgccaagctcctctctgggaactcagacctatatctgcaacgtgaatcacaagccatccaatactaaagtcgacaagaaagtg

SEQ ID NO: 675 - protein, 110 aa, Artificial Sequence; identical to SEQ ID NO: 147
  Description of Artificial Sequence: Synthetic polypeptide

SEQ ID NO: 676 - DNA, 330 bp, Artificial Sequence
  Description of Artificial Sequence: Synthetic polynucleotide
gcaccagagctgctgggaggaccatccgtgttcctgtttccacccaagcctaaagacactctgatgattagcaggacacccgaagtcacttgcgtggtcgtggacgtgagccacgaggaccccgaagtcaagttcaactggtacgtggatggcgtcgaggtgcataatgctaagaccaaacccagagaggaacagtacaactctacttatagggtcgtgagtgtcctgaccgtgctgcaccaggactggctgaacggcaaggagtataagtgcaaagtgtccaataaggcactgcccgcccctatcgagaaaaccatttctaaggcaaaa

SEQ ID NO: 677 - protein, 106 aa, Artificial Sequence; identical to SEQ ID NO: 21
  Description of Artificial Sequence: Synthetic polypeptide

SEQ ID NO: 678 - DNA, 318 bp, Artificial Sequence
  Description of Artificial Sequence: Synthetic polynucleotide
gggcagcctcgcgaaccacaggtctacgtgctgcctccaagtcgagacgagctgacaaagaaccaggtcagcctgctgtgtctggtgaaaggattctatccttccgatatcgccgtggagtgggaatctaatggccagccagagaacaattacctgacttggccccctgtgctggacagcgatggcagcttcttcctgtattcaaagctgaccgtggataaaagccggtggcagcagggcaacgtcttttcctgttctgtgatgcatgaagccctgcacaatcattacacccagaagagtctgtcactgagccccggc

SEQ ID NO: 679 - protein, 213 aa, Artificial Sequence
  Description of Artificial Sequence: Synthetic polypeptide
QIVLTQSPAIMSSSPGEKVTMSCSATSSVTYMYWYQQKPGSSPKPWIFRTSNLASGVPTRFSGSGSGTSYSLTISSMEAEDAATYYCQHYHIYPRTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 680 - DNA, 639 bp, Artificial Sequence
  Description of Artificial Sequence: Synthetic polynucleotide
cagatcgtcctgactcagagccccgctatcatgtcctcatcccctggcgagaaggtcactatgtcatgctccgctacttcctccgtgacatacatgtattggtaccagcagaagccaggcagctcccccaaaccttggatcttccggacttccaacctggcaagcggggtgcccaccagattttcaggcagcgggtccggaacctcttatagtctgacaatttctagtatggaggccgaagacgccgctacctactattgccagcactaccatatctacccaagaacattcggaggcggaactaaactggagctgaaacgaaccgtggcggcgcccagtgtcttcatttttccccctagcgacgaacagctgaagtctgggacagccagtgtggtctgtctgctgaacaacttctaccctagagaggctaaagtgcagtggaaggtcgataacgcactgcagtccggaaattctcaggagagtgtgactgaacaggactcaaaagatagcacctattccctgtcaagcacactgactctgagcaaggccgactacgagaagcataaagtgtatgcttgtgaagtcacccaccaggggctgagttcaccagtcacaaaatcattcaacagaggggagtgc

SEQ ID NO: 681 - protein, 106 aa, Artificial Sequence
  Description of Artificial Sequence: Synthetic polypeptide
QIVLTQSPAIMSSSPGEKVTMSCSATSSVTYMYWYQQKPGSSPKPWIFRTSNLASGVPTRFSGSGSGTSYSLTISSMEAEDAATYYCQHYHIYPRTFGGGTKLELK

SEQ ID NO: 682 - DNA, 318 bp, Artificial Sequence
  Description of Artificial Sequence: Synthetic polynucleotide
cagatcgtcctgactcagagccccgctatcatgtcctcatcccctggcgagaaggtcactatgtcatgctccgctacttcctccgtgacatacatgtattggtaccagcagaagccaggcagctcccccaaaccttggatcttccggacttccaacctggcaagcggggtgcccaccagattttcaggcagcgggtccggaacctcttatagtctgacaatttctagtatggaggccgaagacgccgctacctactattgccagcactaccatatctacccaagaacattcggaggcggaactaaactggagctgaaa

SEQ ID NO: 683 - protein, 5 aa, Artificial Sequence
  Description of Artificial Sequence: Synthetic peptide
SSVTY

SEQ ID NO: 684 - DNA, 15 bp, Artificial Sequence
  Description of Artificial Sequence: Synthetic oligonucleotide
tcctccgtgacatac

SEQ ID NO: 685 - protein, 9 aa, Artificial Sequence
  Description of Artificial Sequence: Synthetic peptide
QHYHIYPRT

SEQ ID NO: 686 - DNA, 27 bp, Artificial Sequence
  Description of Artificial Sequence: Synthetic oligonucleotide
cagcactaccatatctacccaagaaca

SEQ ID NO: 687 - protein, 3 aa, Artificial Sequence
  Description of Artificial Sequence: Synthetic peptide
RTS

SEQ ID NO: 688 - DNA, 9 bp, Artificial Sequence
  Description of Artificial Sequence: Synthetic oligonucleotide
cggacttcc

SEQ ID NO: 689 - protein, 107 aa, Artificial Sequence [sequence omitted]

SEQ ID NO: 690 - DNA, 321 bp, Artificial Sequence
  Description of Artificial Sequence: Synthetic polynucleotide
cgaaccgtggcggcgcccagtgtcttcatttttccccctagcgacgaacagctgaagtctgggacagccagtgtggtctgtctgctgaacaacttctaccctagagaggctaaagtgcagtggaaggtcgataacgcactgcagtccggaaattctcaggagagtgtgactgaacaggactcaaaagatagcacctattccctgtcaagcacactgactctgagcaaggccgactacgagaagcataaagtgtatgcttgtgaagtcacccaccaggggctgagttcaccagtcacaaaatcattcaacagaggggagtgc

SEQ ID NO: 691 - protein, 504 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 692 - DNA, 1512 bp, Artificial Sequence
  Description of Artificial Sequence: Synthetic polynucleotide
gatattcagctgacacagtctccagctagtctggcagtgagcctgggccagcgggctactatcagctgcaaggcaagccagtccgtcgactacgatggggacagctatctgaactggtaccagcagatccccggacagccccctaaactgctgatctacgacgcctcaaatctggtgagcggcatcccacccagattctctggaagtggctcagggaccgattttacactgaacattcaccccgtggagaaggtcgacgccgctacctaccattgccagcagtccactgaggacccctggaccttcggaggaggaacaaagctggaaatcaaaggcggaggaggcagtggaggaggagggagcggaggaggaggaagccaggtgcagctgcagcagagcggagcagaactggtgagacctggaagctccgtcaagatttcctgtaaagcatctggctatgccttttctagttactggatgaattgggtgaagcagaggccaggacagggactggagtggatcggacagatttggcctggggatggagacaccaactacaatggaaagttcaaaggcaaggctaccctgacagcagacgaatcaagctccacagcttacatgcagctgtctagtctggcatcagaggatagcgccgtgtatttttgcgctcggagagaaaccacaactgtcggccgctactattacgccatggactactggggccaggggaccacagtgacagtctcaagcggcgggggaggctccgatatcaagctgcagcagtctggagcagagctggctcgaccaggagccagtgtgaagatgtcatgtaaaaccagcggctatactttcaccaggtacacaatgcactgggtgaaacagcgcccaggacagggcctggaatggatcggatacattaacccctccaggggctataccaactacaatcagaagttcaaggataaagccactctgactaccgacaagtcctctagtaccgcttatatgcagctgtcaagcctgacatccgaggactctgcagtgtattactgcgcccgctattacgacgatcattattgtctggattactgggggcagggaacaactctgactgtgtcctctgtcgaagggggaagtggagggtcaggaggcagcggaggcagcggaggggtggacgatatccagctgacccagtcccctgccattatgagcgcttccccaggcgagaaggtgacaatgacttgcagggctagttcaagcgtctcttatatgaattggtatcagcagaagtctggcactagtcctaaacgatggatctatgacacctccaaagtggcatctggggtcccataccggttctctggcagtgggtcaggaactagctattccctgaccatttcctctatggaggcagaagatgcagccacctattactgtcagcagtggagttcaaatcccctgacatttggcgccgggactaagctggagctgaaacaccatcaccatcaccat

SEQ ID NO: 693 - protein, 111 aa, Artificial Sequence; identical to SEQ ID NO: 59
  Description of Artificial Sequence: Synthetic polypeptide

SEQ ID NO: 694 - DNA, 333 bp, Artificial Sequence
  Description of Artificial Sequence: Synthetic polynucleotide
gatattcagctgacacagtctccagctagtctggcagtgagcctgggccagcgggctactatcagctgcaaggcaagccagtccgtcgactacgatggggacagctatctgaactggtaccagcagatccccggacagccccctaaactgctgatctacgacgcctcaaatctggtgagcggcatcccacccagattctctggaagtggctcagggaccgattttacactgaacattcaccccgtggagaaggtcgacgccgctacctaccattgccagcagtccactgaggacccctggaccttcggaggaggaacaaagctggaaatcaaa

SEQ ID NO: 695 - protein, 10 aa, Artificial Sequence
  Description of Artificial Sequence: Synthetic peptide
QSVDYDGDSY

SEQ ID NO: 696 - DNA, 30 bp, Artificial Sequence
  Description of Artificial Sequence: Synthetic oligonucleotide
cagtccgtcgactacgatggggacagctat

SEQ ID NO: 697 - protein, 9 aa, Artificial Sequence
  Description of Artificial Sequence: Synthetic peptide
QQSTEDPWT

SEQ ID NO: 698 - DNA, 27 bp, Artificial Sequence
  Description of Artificial Sequence: Synthetic oligonucleotide
cagcagtccactgaggacccctggacc

SEQ ID NO: 699 - protein, 3 aa, Artificial Sequence
  Description of Artificial Sequence: Synthetic peptide
DAS

SEQ ID NO: 700 - DNA, 9 bp, Artificial Sequence
  Description of Artificial Sequence: Synthetic oligonucleotide
gacgcctca

SEQ ID NO: 701 - protein, 124 aa, Artificial Sequence; identical to SEQ ID NO: 79
  Description of Artificial Sequence: Synthetic polypeptide

SEQ ID NO: 702 - DNA, 372 bp, Artificial Sequence
  Description of Artificial Sequence: Synthetic polynucleotide
caggtgcagctgcagcagagcggagcagaactggtgagacctggaagctccgtcaagatttcctgtaaagcatctggctatgccttttctagttactggatgaattgggtgaagcagaggccaggacagggactggagtggatcggacagatttggcctggggatggagacaccaactacaatggaaagttcaaaggcaaggctaccctgacagcagacgaatcaagctccacagcttacatgcagctgtctagtctggcatcagaggatagcgccgtgtatttttgcgctcggagagaaaccacaactgtcggccgctactattacgccatggactactggggccaggggaccacagtgacagtctcaagc

SEQ ID NO: 703 - protein, 8 aa, Artificial Sequence
  Description of Artificial Sequence: Synthetic peptide
GYAFSSYW

SEQ ID NO: 704 - DNA, 24 bp, Artificial Sequence
  Description of Artificial Sequence: Synthetic oligonucleotide
ggctatgccttttctagttactgg

SEQ ID NO: 705 - protein, 17 aa, Artificial Sequence
  Description of Artificial Sequence: Synthetic peptide
ARRETTTVGRYYYAMDY

SEQ ID NO: 706 - DNA, 51 bp, Artificial Sequence
  Description of Artificial Sequence: Synthetic oligonucleotide
gctcggagagaaaccacaactgtcggccgctactattacgccatggactac

SEQ ID NO: 707 - protein, 8 aa, Artificial Sequence
  Description of Artificial Sequence: Synthetic peptide
IWPGDGDT

SEQ ID NO: 708 - DNA, 24 bp, Artificial Sequence
  Description of Artificial Sequence: Synthetic oligonucleotide
atttggcctggggatggagacacc

SEQ ID NO: 709 - protein, 119 aa, Artificial Sequence; identical to SEQ ID NO: 357
  Description of Artificial Sequence: Synthetic polypeptide

SEQ ID NO: 710 - DNA, 357 bp, Artificial Sequence
  Description of Artificial Sequence: Synthetic polynucleotide
gatatcaagctgcagcagtctggagcagagctggctcgaccaggagccagtgtgaagatgtcatgtaaaaccagcggctatactttcaccaggtacacaatgcactgggtgaaacagcgcccaggacagggcctggaatggatcggatacattaacccctccaggggctataccaactacaatcagaagttcaaggataaagccactctgactaccgacaagtcctctagtaccgcttatatgcagctgtcaagcctgacatccgaggactctgcagtgtattactgcgcccgctattacgacgatcattattgtctggattactgggggcagggaacaactctgactgtgtcctct

SEQ ID NO: 711 - protein, 8 aa, Artificial Sequence
  Description of Artificial Sequence: Synthetic peptide
GYTFTRYT

SEQ ID NO: 712 - DNA, 24 bp, Artificial Sequence
  Description of Artificial Sequence: Synthetic oligonucleotide
ggctatactttcaccaggtacaca

SEQ ID NO: 713 - protein, 12 aa, Artificial Sequence
  Description of Artificial Sequence: Synthetic peptide
ARYYDDHYCLDY

SEQ ID NO: 714 - DNA, 36 bp, Artificial Sequence
  Description of Artificial Sequence: Synthetic oligonucleotide
gcccgctattacgacgatcattattgtctggattac

SEQ ID NO: 715 - protein, 8 aa, Artificial Sequence
  Description of Artificial Sequence: Synthetic peptide
INPSRGYT

SEQ ID NO: 716 - DNA, 24 bp, Artificial Sequence
  Description of Artificial Sequence: Synthetic oligonucleotide
attaacccctccaggggctatacc

SEQ ID NO: 717 - protein, 106 aa, Artificial Sequence; identical to SEQ ID NO: 365
  Description of Artificial Sequence: Synthetic polypeptide

SEQ ID NO: 718 - DNA, 318 bp, Artificial Sequence
  Description of Artificial Sequence: Synthetic polynucleotide
gatatccagctgacccagtcccctgccattatgagcgcttccccaggcgagaaggtgacaatgacttgcagggctagttcaagcgtctcttatatgaattggtatcagcagaagtctggcactagtcctaaacgatggatctatgacacctccaaagtggcatctggggtcccataccggttctctggcagtgggtcaggaactagctattccctgaccatttcctctatggaggcagaagatgcagccacctattactgtcagcagtggagttcaaatcccctgacatttggcgccgggactaagctggagctgaaa

SEQ ID NO: 719 - protein, 5 aa, Artificial Sequence
  Description of Artificial Sequence: Synthetic peptide
SSVSY

SEQ ID NO: 720 - DNA, 15 bp, Artificial Sequence
  Description of Artificial Sequence: Synthetic oligonucleotide
tcaagcgtctcttat

SEQ ID NO: 721 - protein, 9 aa, Artificial Sequence
  Description of Artificial Sequence: Synthetic peptide
QQWSSNPLT

SEQ ID NO: 722 - DNA, 27 bp, Artificial Sequence
  Description of Artificial Sequence: Synthetic oligonucleotide
cagcagtggagttcaaatcccctgaca

SEQ ID NO: 723 - protein, 3 aa, Artificial Sequence
  Description of Artificial Sequence: Synthetic peptide
DTS

SEQ ID NO: 724 - DNA, 9 bp, Artificial Sequence
  Description of Artificial Sequence: Synthetic oligonucleotide
gacacctcc

SEQ ID NO: 725 - protein, 477 aa, Artificial Sequence
  Description of Artificial Sequence: Synthetic polypeptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 726 - DNA, 1431 bp, Artificial Sequence
  Description of Artificial Sequence: Synthetic polynucleotide
gacatcaaactgcagcagagcggagctgagctggcacgaccaggagccagtgtgaaaatgtcatgcaagacaagcggctacaccttcacacggtatactatgcactgggtgaaacagagacccggccaggggctggaatggatcggatatattaacccttcccgaggctacaccaactataatcagaagtttaaagacaaggccaccctgaccacagataagagctcctctacagcttacatgcagctgagttcactgactagtgaggactcagctgtgtactattgcgcaaggtactatgacgatcattactgtctggattattggggacagggcactaccctgactgtcagctccgtggaaggagggagcggaggctccggaggatctggcgggagtggaggcgtggacgatatccagctgacccagtccccagcaattatgtccgcctctcccggcgagaaagtgactatgacctgccgcgcctctagttcagtgagctacatgaactggtatcagcagaaatcaggcaccagccccaagagatggatctacgacacatccaaggtcgcttctggggtgccttataggttcagtgggtcaggaagcggcacttcctactctctgaccattagctccatggaggcagaagatgccgctacatactattgtcagcagtggtctagtaatccactgacatttggggccggaactaaactggagctgaaggcagccgaacccaaatcaagcgacaagacacacacttgcccaccttgtccagcaccagaactgctgggaggacctagcgtgttcctgtttccacccaaaccaaaggatacactgatgatcagccggacccctgaggtcacatgcgtggtcgtggacgtgagccacgaggaccccgaagtcaagttcaactggtacgtggacggcgtcgaagtgcataatgccaaaaccaagcctagggaggaacagtacaatagtacttatcgcgtcgtgtcagtcctgaccgtgctgcatcaggattggctgaacgggaaggagtacaaatgcaaggtgtccaacaaggccctgcctgctccaatcgagaagaccatttctaaagcaaagggccagccccgagaacctcaggtctacgtgtatcctccatcccgggacgagctgaccaaaaaccaggtctctctgacatgtctggtgaaggggttttatccatctgatattgctgtggagtgggaaagtaatggacagcccgagaacaattacaagacaactccccctgtgctggactccgatggatctttcgctctggtcagcaaactgacagtggacaagtccagatggcagcagggcaacgtctttagttgttcagtgatgcacgaggcactgcacaatcattacactcagaaaagcctgtccctgtctcccggcaag

SEQ ID NO: 727 - protein, 119 aa, Artificial Sequence; identical to SEQ ID NO: 357
  Description of Artificial Sequence: Synthetic polypeptide

SEQ ID NO: 728 - DNA, 357 bp, Artificial Sequence
  Description of Artificial Sequence: Synthetic polynucleotide
gacatcaaactgcagcagagcggagctgagctggcacgaccaggagccagtgtgaaaatgtcatgcaagacaagcggctacaccttcacacggtatactatgcactgggtgaaacagagacccggccaggggctggaatggatcggatatattaacccttcccgaggctacaccaactataatcagaagtttaaagacaaggccaccctgaccacagataagagctcctctacagcttacatgcagctgagttcactgactagtgaggactcagctgtgtactattgcgcaaggtactatgacgatcattactgtctggattattggggacagggcactaccctgactgtcagctcc

SEQ ID NO: 729 - protein, 8 aa, Artificial Sequence
  Description of Artificial Sequence: Synthetic peptide
GYTFTRYT

SEQ ID NO: 730 - DNA, 24 bp, Artificial Sequence
  Description of Artificial Sequence: Synthetic oligonucleotide
ggctacaccttcacacggtatact

SEQ ID NO: 731 - protein, 12 aa, Artificial Sequence
  Description of Artificial Sequence: Synthetic peptide
ARYYDDHYCLDY

SEQ ID NO: 732 - DNA, 36 bp, Artificial Sequence; identical to SEQ ID NO: 362
  Description of Artificial Sequence: Synthetic oligonucleotide

SEQ ID NO: 733 - protein, 8 aa, Artificial Sequence
  Description of Artificial Sequence: Synthetic peptide
INPSRGYT

SEQ ID NO: 734 - DNA, 24 bp, Artificial Sequence
  Description of Artificial Sequence: Synthetic oligonucleotide
attaacccttcccgaggctacacc

SEQ ID NO: 735 - protein, 106 aa, Artificial Sequence; identical to SEQ ID NO: 365
  Description of Artificial Sequence: Synthetic polypeptide

SEQ ID NO: 736 - DNA, 318 bp, Artificial Sequence
  Description of Artificial Sequence: Synthetic polynucleotide
gatatccagctgacccagtccccagcaattatgtccgcctctcccggcgagaaagtgactatgacctgccgcgcctctagttcagtgagctacatgaactggtatcagcagaaatcaggcaccagccccaagagatggatctacgacacatccaaggtcgcttctggggtgccttataggttcagtgggtcaggaagcggcacttcctactctctgaccattagctccatggaggcagaagatgccgctacatactattgtcagcagtggtctagtaatccactgacatttggggccggaactaaactggagctgaag

SEQ ID NO: 737 - protein, 5 aa, Artificial Sequence
  Description of Artificial Sequence: Synthetic peptide
SSVSY

SEQ ID NO: 738 - DNA, 15 bp, Artificial Sequence
  Description of Artificial Sequence: Synthetic oligonucleotide
agttcagtgagctac

SEQ ID NO: 739 - protein, 9 aa, Artificial Sequence
  Description of Artificial Sequence: Synthetic peptide
QQWSSNPLT

SEQ ID NO: 740 - DNA, 27 bp, Artificial Sequence
  Description of Artificial Sequence: Synthetic oligonucleotide
cagcagtggtctagtaatccactgaca

SEQ ID NO: 741 - protein, 3 aa, Artificial Sequence
  Description of Artificial Sequence: Synthetic peptide
DTS

SEQ ID NO: 742 - DNA, 9 bp, Artificial Sequence
  Description of Artificial Sequence: Synthetic oligonucleotide
gacacatcc

SEQ ID NO: 743 - protein, 110 aa, Artificial Sequence; identical to SEQ ID NO: 147
  Description of Artificial Sequence: Synthetic polypeptide

SEQ ID NO: 744 - DNA, 330 bp, Artificial Sequence
  Description of Artificial Sequence: Synthetic polynucleotide
gcaccagaactgctgggaggacctagcgtgttcctgtttccacccaaaccaaaggatacactgatgatcagccggacccctgaggtcacatgcgtggtcgtggacgtgagccacgaggaccccgaagtcaagttcaactggtacgtggacggcgtcgaagtgcataatgccaaaaccaagcctagggaggaacagtacaatagtacttatcgcgtcgtgtcagtcctgaccgtgctgcatcaggattggctgaacgggaaggagtacaaatgcaaggtgtccaacaaggccctgcctgctccaatcgagaagaccatttctaaagcaaag

SEQ ID NO: 745 - protein, 106 aa, Artificial Sequence; identical to SEQ ID NO: 89
  Description of Artificial Sequence: Synthetic polypeptide

SEQ ID NO: 746 - DNA, 318 bp, Artificial Sequence
  Description of Artificial Sequence: Synthetic polynucleotide
ggccagccccgagaacctcaggtctacgtgtatcctccatcccgggacgagctgaccaaaaaccaggtctctctgacatgtctggtgaaggggttttatccatctgatattgctgtggagtgggaaagtaatggacagcccgagaacaattacaagacaactccccctgtgctggactccgatggatctttcgctctggtcagcaaactgacagtggacaagtccagatggcagcagggcaacgtctttagttgttcagtgatgcacgaggcactgcacaatcattacactcagaaaagcctgtccctgtctcccggc

SEQ ID NO: 747 - protein, 477 aa, Artificial Sequence
  Description of Artificial Sequence: Synthetic polypeptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKAAEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 748 - DNA, 1431 bp, Artificial Sequence
  Description of Artificial Sequence: Synthetic polynucleotide
gacatcaaactgcagcagagcggagcagagctggctcgaccaggagccagtgtgaaaatgtcatgcaagaccagcggctacacattcactcggtatacaatgcactgggtgaagcagagaccaggacagggactggaatggatcggatatattaacccttcccgaggctacacaaactacaaccagaagtttaaagacaaggcaactctgaccacagataagagctcctctaccgcctacatgcagctgagttcactgacaagtgaggactcagccgtgtactattgcgctaggtactatgacgatcattactgtctggattattggggacagggcactaccctgactgtcagctccgtggaaggagggagcggaggctccggaggatctggcgggagtggaggcgtggacgatatccagctgacccagtccccagctattatgtccgcatctcccggcgagaaagtcaccatgacatgccgcgcctctagttcagtgagctacatgaactggtatcagcagaaatcaggcactagccccaagagatggatctacgacacctccaaggtcgcttctggggtgccttataggttcagtgggtcaggaagcggcacctcctactctctgacaattagctccatggaggctgaagatgccgctacctactattgtcagcagtggtctagtaatccactgacttttggggcaggaaccaaactggagctgaaggcagccgaacccaaatcaagcgacaagactcacacctgcccaccttgtccagcaccagaagctgcaggaggacctagcgtgttcctgtttccacccaaaccaaaggatacactgatgatcagccggacacctgaggtcacttgcgtggtcgtggacgtgagccacgaggaccccgaagtcaagttcaactggtacgtggacggcgtcgaagtgcataatgccaaaaccaagcctagggaggaacagtacaatagtacatatagagtcgtgtcagtgctgaccgtcctgcatcaggattggctgaacgggaaggagtacaaatgcaaggtgtccaacaaggcactgcctgccccaatcgagaagaccatttctaaagcaaagggccagccccgagaacctcaggtctatgtgctgcctccatcccgggacgagctgacaaaaaaccaggtctctctgctgtgtctggtgaaggggttctacccatctgatattgctgtggagtgggaaagtaatggacagcccgagaacaattatctgacatggccccctgtgctggactccgatggatctttctttctgtacagcaaactgactgtggacaagtccagatggcagcagggcaacgtctttagttgttcagtgatgcacgaggccctgcacaatcattacacccagaaaagcctgtccctgtctcccggcaag

SEQ ID NO: 749 - protein, 119 aa, Artificial Sequence; identical to SEQ ID NO: 357
  Description of Artificial Sequence: Synthetic polypeptide

SEQ ID NO: 750 - DNA, 357 bp, Artificial Sequence
  Description of Artificial Sequence: Synthetic polynucleotide
gacatcaaactgcagcagagcggagcagagctggctcgaccaggagccagtgtgaaaatgtcatgcaagaccagcggctacacattcactcggtatacaatgcactgggtgaagcagagaccaggacagggactggaatggatcggatatattaacccttcccgaggctacacaaactacaaccagaagtttaaagacaaggcaactctgaccacagataagagctcctctaccgcctacatgcagctgagttcactgacaagtgaggactcagccgtgtactattgcgctaggtactatgacgatcattactgtctggattattggggacagggcactaccctgactgtcagctcc

SEQ ID NO: 751 - protein, 8 aa, Artificial Sequence
  Description of Artificial Sequence: Synthetic peptide
GYTFTRYT

SEQ ID NO: 752 - DNA, 24 bp, Artificial Sequence
  Description of Artificial Sequence: Synthetic oligonucleotide
ggctacacattcactcggtataca

SEQ ID NO: 753 - protein, 12 aa, Artificial Sequence
  Description of Artificial Sequence: Synthetic peptide
ARYYDDHYCLDY

SEQ ID NO: 754 - DNA, 36 bp, Artificial Sequence
  Description of Artificial Sequence: Synthetic oligonucleotide
gctaggtactatgacgatcattactgtctggattat

SEQ ID NO: 755 - protein, 8 aa, Artificial Sequence
  Description of Artificial Sequence: Synthetic peptide
INPSRGYT

SEQ ID NO: 756 - DNA, 24 bp, Artificial Sequence
  Description of Artificial Sequence: Synthetic oligonucleotide
attaacccttcccgaggctacaca

SEQ ID NO: 757 - protein, 106 aa, Artificial Sequence; identical to SEQ ID NO: 365
  Description of Artificial Sequence: Synthetic polypeptide

SEQ ID NO: 758 - DNA, 318 bp, Artificial Sequence
  Description of Artificial Sequence: Synthetic polynucleotide
gatatccagctgacccagtccccagctattatgtccgcatctcccggcgagaaagtcaccatgacatgccgcgcctctagttcagtgagctacatgaactggtatcagcagaaatcaggcactagccccaagagatggatctacgacacctccaaggtcgcttctggggtgccttataggttcagtgggtcaggaagcggcacctcctactctctgacaattagctccatggaggctgaagatgccgctacctactattgtcagcagtggtctagtaatccactgacttttggggcaggaaccaaactggagctgaag

SEQ ID NO: 759 - protein, 5 aa, Artificial Sequence
  Description of Artificial Sequence: Synthetic peptide
SSVSY

SEQ ID NO: 760 - DNA, 15 bp, Artificial Sequence
  Description of Artificial Sequence: Synthetic oligonucleotide
agttcagtgagctac

SEQ ID NO: 761 - protein, 9 aa, Artificial Sequence
  Description of Artificial Sequence: Synthetic peptide
QQWSSNPLT

SEQ ID NO: 762 - DNA, 27 bp, Artificial Sequence
  Description of Artificial Sequence: Synthetic oligonucleotide
cagcagtggtctagtaatccactgact

SEQ ID NO: 763 - protein, 3 aa, Artificial Sequence
  Description of Artificial Sequence: Synthetic peptide
DTS

SEQ ID NO: 764 - DNA, 9 bp, Artificial Sequence
  Description of Artificial Sequence: Synthetic oligonucleotide
gacacctcc

SEQ ID NO: 765 - protein, 110 aa, Artificial Sequence; identical to SEQ ID NO: 495
  Description of Artificial Sequence: Synthetic polypeptide

SEQ ID NO: 766 - DNA, 330 bp, Artificial Sequence
  Description of Artificial Sequence: Synthetic polynucleotide
gcaccagaagctgcaggaggacctagcgtgttcctgtttccacccaaaccaaaggatacactgatgatcagccggacacctgaggtcacttgcgtggtcgtggacgtgagccacgaggaccccgaagtcaagttcaactggtacgtggacggcgtcgaagtgcataatgccaaaaccaagcctagggaggaacagtacaatagtacatatagagtcgtgtcagtgctgaccgtcctgcatcaggattggctgaacgggaaggagtacaaatgcaaggtgtccaacaaggcactgcctgccccaatcgagaagaccatttctaaagcaaag

SEQ ID NO: 767 - protein, 106 aa, Artificial Sequence; identical to SEQ ID NO: 21
  Description of Artificial Sequence: Synthetic polypeptide

SEQ ID NO: 768 - DNA, 318 bp, Artificial Sequence
  Description of Artificial Sequence: Synthetic polynucleotide
ggccagccccgagaacctcaggtctatgtgctgcctccatcccgggacgagctgacaaaaaaccaggtctctctgctgtgtctggtgaaggggttctacccatctgatattgctgtggagtgggaaagtaatggacagcccgagaacaattatctgacatggccccctgtgctggactccgatggatctttctttctgtacagcaaactgactgtggacaagtccagatggcagcagggcaacgtctttagttgttcagtgatgcacgaggccctgcacaatcattacacccagaaaagcctgtccctgtctcccggc

SEQ ID NO: 769 - protein, 474 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 770 - DNA, 1422 bp, Artificial Sequence
  Description of Artificial Sequence: Synthetic polynucleotide
cagatcgtcctgacacagagcccagcaatcatgtcagccagccccggcgagaaagtcaccatgacatgctcagccagctcctctgtgagctacatgaactggtatcagcagaaaagcggaacatcccccaagagatggatctacgacacttccaagctggcttctggagtgcctgcacacttcaggggcagcggctctgggactagttattcactgaccatttccggcatggaggccgaagatgccgctacctactattgccagcagtggagttcaaacccattcacatttggatctggcactaagctggaaattaatggcggaggaggctccggaggaggagggtctggaggaggaggaagtcaggtccagctgcagcagagcggagctgagctggcacgaccaggagcaagtgtgaaaatgtcctgtaaggccagcggctacactttcacccggtataccatgcattgggtgaaacagagacccgggcagggactggaatggatcgggtacattaatccttcccgaggatacacaaactacaaccagaagtttaaagacaaggctaccctgaccacagataagagctcctctacagcatatatgcagctgagttcactgacttctgaggacagtgccgtgtactattgcgctaggtactatgacgatcactactccctggattattggggccaggggactaccctgaccgtgagctccgcagccgaacctaaatctagtgacaagacacatacttgcccaccttgtccagcaccagagctgctgggaggacctagcgtgttcctgtttccacccaaaccaaaggatacactgatgatctcccggacccctgaagtcacatgtgtggtcgtggacgtgtctcacgaggaccccgaagtcaagttcaactggtacgtggacggcgtcgaggtgcataatgccaaaactaagcccagggaggaacagtacaactccacttatcgcgtcgtgtctgtcctgaccgtgctgcaccaggattggctgaacggcaaggagtacaaatgcaaggtgagcaacaaggccctgcctgctccaatcgagaagaccattagcaaagcaaaggggcagccccgagaacctcaggtctacgtgtatcctccatctcgggacgagctgaccaaaaaccaggtcagtctgacatgtctggtgaagggcttttacccaagcgatattgctgtggagtgggaatccaatgggcagcccgaaaacaattataagacaactccccctgtgctggactcagatgggagcttcgccctggtcagtaaactgactgtggacaagtcacggtggcagcagggaaacgtctttagctgttccgtgatgcatgaggctctgcacaatcattacacccagaaatctctgagtctgtcacccggcaag

SEQ ID NO: 771 - protein, 106 aa, Artificial Sequence [sequence omitted]

SEQ ID NO: 772 - DNA, 318 bp, Artificial Sequence
  Description of Artificial Sequence: Synthetic polynucleotide
cagatcgtcctgacacagagcccagcaatcatgtcagccagccccggcgagaaagtcaccatgacatgctcagccagctcctctgtgagctacatgaactggtatcagcagaaaagcggaacatcccccaagagatggatctacgacacttccaagctggcttctggagtgcctgcacacttcaggggcagcggctctgggactagttattcactgaccatttccggcatggaggccgaagatgccgctacctactattgccagcagtggagttcaaacccattcacatttggatctggcactaagctggaaattaat

SEQ ID NO: 773 - protein, 5 aa, Artificial Sequence
  Description of Artificial Sequence: Synthetic peptide
SSVSY

SEQ ID NO: 774 - DNA, 15 bp, Artificial Sequence
  Description of Artificial Sequence: Synthetic oligonucleotide
tcctctgtgagctac

SEQ ID NO: 775 - protein, 9 aa, Artificial Sequence
  Description of Artificial Sequence: Synthetic peptide
QQWSSNPFT

SEQ ID NO: 776 - DNA, 27 bp, Artificial Sequence
  Description of Artificial Sequence: Synthetic oligonucleotide
cagcagtggagttcaaacccattcaca

SEQ ID NO: 777 - protein, 3 aa, Artificial Sequence
  Description of Artificial Sequence: Synthetic peptide
DTS

SEQ ID NO: 778 - DNA, 9 bp, Artificial Sequence
  Description of Artificial Sequence: Synthetic oligonucleotide
gacacttcc

SEQ ID NO: 779 - protein, 119 aa, Artificial Sequence; identical to SEQ ID NO: 33
  Description of Artificial Sequence: Synthetic polypeptide

SEQ ID NO: 780 - DNA, 357 bp, Artificial Sequence
  Description of Artificial Sequence: Synthetic polynucleotide
caggtccagctgcagcagagcggagctgagctggcacgaccaggagcaagtgtgaaaatgtcctgtaaggccagcggctacactttcacccggtataccatgcattgggtgaaacagagacccgggcagggactggaatggatcgggtacattaatccttcccgaggatacacaaactacaaccagaagtttaaagacaaggctaccctgaccacagataagagctcctctacagcatatatgcagctgagttcactgacttctgaggacagtgccgtgtactattgcgctaggtactatgacgatcactactccctggattattggggccaggggactaccctgaccgtgagctcc

SEQ ID NO: 781 - protein, 8 aa, Artificial Sequence
  Description of Artificial Sequence: Synthetic peptide
GYTFTRYT

SEQ ID NO: 782 - DNA, 24 bp, Artificial Sequence
  Description of Artificial Sequence: Synthetic oligonucleotide
ggctacactttcacccggtatacc

SEQ ID NO: 783 - protein, 12 aa, Artificial Sequence
  Description of Artificial Sequence: Synthetic peptide
ARYYDDHYSLDY

SEQ ID NO: 784 - DNA, 36 bp, Artificial Sequence; identical to SEQ ID NO: 470
  Description of Artificial Sequence: Synthetic oligonucleotide

SEQ ID NO: 785 - protein, 8 aa, Artificial Sequence
  Description of Artificial Sequence: Synthetic peptide
INPSRGYT

SEQ ID NO: 786 - DNA, 24 bp, Artificial Sequence
  Description of Artificial Sequence: Synthetic oligonucleotide
attaatccttcccgaggatacaca

SEQ ID NO: 787 - protein, 110 aa, Artificial Sequence; identical to SEQ ID NO: 147
  Description of Artificial Sequence: Synthetic polypeptide

SEQ ID NO: 788 - DNA, 330 bp, Artificial Sequence
  Description of Artificial Sequence: Synthetic polynucleotide
gcaccagagctgctgggaggacctagcgtgttcctgtttccacccaaaccaaaggatacactgatgatctcccggacccctgaagtcacatgtgtggtcgtggacgtgtctcacgaggaccccgaagtcaagttcaactggtacgtggacggcgtcgaggtgcataatgccaaaactaagcccagggaggaacagtacaactccacttatcgcgtcgtgtctgtcctgaccgtgctgcaccaggattggctgaacggcaaggagtacaaatgcaaggtgagcaacaaggccctgcctgctccaatcgagaagaccattagcaaagcaaag

SEQ ID NO: 789 - protein, 106 aa, Artificial Sequence; identical to SEQ ID NO: 89
  Description of Artificial Sequence: Synthetic polypeptide

SEQ ID NO: 790 - DNA, 318 bp, Artificial Sequence
  Description of Artificial Sequence: Synthetic polynucleotide
gggcagccccgagaacctcaggtctacgtgtatcctccatctcgggacgagctgaccaaaaaccaggtcagtctgacatgtctggtgaagggcttttacccaagcgatattgctgtggagtgggaatccaatgggcagcccgaaaacaattataagacaactccccctgtgctggactcagatgggagcttcgccctggtcagtaaactgactgtggacaagtcacggtggcagcagggaaacgtctttagctgttccgtgatgcatgaggctctgcacaatcattacacccagaaatctctgagtctgtcacccggc

SEQ ID NO: 791 - protein, 220 aa, Artificial Sequence
  Description of Artificial Sequence: Synthetic polypeptide
DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 792 - DNA, 660 bp, Artificial Sequence
  Description of Artificial Sequence: Synthetic polynucleotide
gacattgtgatgacacagtcccctgactctctggctgtgtccctgggcgagcgagcaactatcaattgcaagagctcccagtccgtcctgaactctgggaatcagaaaaactatctgacctggtaccagcagaagcccggacagccccctaaactgctgatctattgggctagtacccgggagtcaggcgtgcctgacagattcagtggctcagggagcggaacagattttaccctgacaatttctagtctgcaggcagaagacgtggccgtctactattgccagagtgattactcatatccttacacattcggccaggggactaagctggagatcaaaaggactgtggccgctccaagtgtcttcatttttccaccctccgacgaacagctgaagtccggcacagcctctgtggtctgtctgctgaacaatttttatccacgcgaggccaaggtgcagtggaaagtcgataatgctctgcagagcgggaactcccaggagtctgtgaccgaacaggacagtaaggattcaacatacagcctgtcaagcactctgaccctgtctaaagcagattatgagaagcacaaagtgtacgcctgcgaagtcactcatcagggactgtcctctcccgtgaccaagagcttcaacagaggcgaatgt

SEQ ID NO: 793 - protein, 113 aa, Artificial Sequence
  Description of Artificial Sequence: Synthetic polypeptide
DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSYPYTFGQGTKLEIK

SEQ ID NO: 794 - DNA, 339 bp, Artificial Sequence
  Description of Artificial Sequence: Synthetic polynucleotide
gacattgtgatgacacagtcccctgactctctggctgtgtccctgggcgagcgagcaactatcaattgcaagagctcccagtccgtcctgaactctgggaatcagaaaaactatctgacctggtaccagcagaagcccggacagccccctaaactgctgatctattgggctagtacccgggagtcaggcgtgcctgacagattcagtggctcagggagcggaacagattttaccctgacaatttctagtctgcaggcagaagacgtggccgtctactattgccagagtgattactcatatccttacacattcggccaggggactaagctggagatcaaa

SEQ ID NO: 795 - protein, 12 aa, Artificial Sequence
  Description of Artificial Sequence: Synthetic peptide
QSVLNSGNQKNY

SEQ ID NO: 796 - DNA, 36 bp, Artificial Sequence
  Description of Artificial Sequence: Synthetic oligonucleotide
cagtccgtcctgaactctgggaatcagaaaaactat

SEQ ID NO: 797 - protein, 9 aa, Artificial Sequence
  Description of Artificial Sequence: Synthetic peptide
QSDYSYPYT

SEQ ID NO: 798 - DNA, 27 bp, Artificial Sequence
  Description of Artificial Sequence: Synthetic oligonucleotide
cagagtgattactcatatccttacaca

SEQ ID NO: 799 - protein, 3 aa, Artificial Sequence
  Description of Artificial Sequence: Synthetic peptide
WAS

SEQ ID NO: 800 - DNA, 9 bp, Artificial Sequence
  Description of Artificial Sequence: Synthetic oligonucleotide
tgggctagt

SEQ ID NO: 801 - protein, 107 aa, Artificial Sequence [sequence omitted]

SEQ ID NO: 802 - DNA, 321 bp, Artificial Sequence
  Description of Artificial Sequence: Synthetic polynucleotide
aggactgtggccgctccaagtgtcttcatttttccaccctccgacgaacagctgaagtccggcacagcctctgtggtctgtctgctgaacaatttttatccacgcgaggccaaggtgcagtggaaagtcgataatgctctgcagagcgggaactcccaggagtctgtgaccgaacaggacagtaaggattcaacatacagcctgtcaagcactctgaccctgtctaaagcagattatgagaagcacaaagtgtacgcctgcgaagtcactcatcagggactgtcctctcccgtgaccaagagcttcaacagaggcgaatgt

SEQ ID NO: 803 - protein, 454 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 804 - DNA, 1362 bp, Artificial Sequence
  Description of Artificial Sequence: Synthetic polynucleotide
caggtccagctgcagcagagcggagccgaactggtcagacccggcagctccgtgaaaatcagttgcaaggcttcaggctatgcattctctagttactggatgaactgggtgaagcagaggcctgggcagggactggaatggatcgggcagatttggccaggcgacggggatactaactataatgggaagttcaaaggaaaggccactctgaccgctgacgagtcaagctccaccgcctatatgcagctgtctagtctggcatctgaggatagtgccgtgtacttttgcgctcggagagaaaccacaactgtgggccgctactattacgctatggactattggggacagggcaccacagtcactgtgtcaagcgctagcaccaaagggccttccgtgtttccactggcaccctcctctaagagcacttccggaggaaccgcagctctgggatgtctggtgaaggattacttcccagagcccgtcacagtgtcatggaacagcggagcactgaccagcggagtccacacatttcctgccgtgctgcagagttcaggcctgtattccctgagctccgtggtcacagtgccatctagttcactggggacacagacttacatctgcaacgtgaatcacaaaccatccaatactaaggtcgacaagaaagtggaacccaaatcttgtgataagacccatacatgccccccttgtcctgctccagagctgctgggaggaccaagcgtgttcctgtttccacccaaacctaaggacactctgatgattagccgaacaccagaagtcacttgcgtggtcgtggacgtgagccacgaggaccccgaagtcaagttcaactggtacgtggatggggtcgaggtgcataatgccaaaaccaagcccagggaggaacagtataattctacataccgcgtcgtgagtgtcctgactgtgctgcaccaggactggctgaacggaaaggagtacaaatgcaaggtgtccaacaaggcactgcccgcccctatcgagaagaccatttctaaagcaaagggccagcctcgagaaccacaggtctatgtgctgcctccaagtcgggacgagctgacaaaaaaccaggtcagcctgctgtgtctggtgaaggggttctacccctccgatattgccgtggagtgggaatctaatggacagcctgaaaacaattatctgacctggccccctgtgctggactccgatggatctttctttctgtactcaaaactgacagtggataagagcaggtggcagcagggcaacgtcttttcttgtagtgtgatgcatgaggccctgcacaatcattacacccagaaatcactgagcctgtcccccggcaag

SEQ ID NO: 805 - protein, 124 aa, Artificial Sequence; identical to SEQ ID NO: 79
  Description of Artificial Sequence: Synthetic polypeptide

SEQ ID NO: 806 - DNA, 372 bp, Artificial Sequence
  Description of Artificial Sequence: Synthetic polynucleotide
caggtccagctgcagcagagcggagccgaactggtcagacccggcagctccgtgaaaatcagttgcaaggcttcaggctatgcattctctagttactggatgaactgggtgaagcagaggcctgggcagggactggaatggatcgggcagatttggccaggcgacggggatactaactataatgggaagttcaaaggaaaggccactctgaccgctgacgagtcaagctccaccgcctatatgcagctgtctagtctggcatctgaggatagtgccgtgtacttttgcgctcggagagaaaccacaactgtgggccgctactattacgctatggactattggggacagggcaccacagtcactgtgtcaagc

SEQ ID NO: 807 - protein, 8 aa, Artificial Sequence
  Description of Artificial Sequence: Synthetic peptide
GYAFSSYW

SEQ ID NO: 808 - DNA, 24 bp, Artificial Sequence
  Description of Artificial Sequence: Synthetic oligonucleotide
ggctatgcattctctagttactgg

SEQ ID NO: 809 - protein, 17 aa, Artificial Sequence
  Description of Artificial Sequence: Synthetic peptide
ARRETTTVGRYYYAMDY

SEQ ID NO: 810 - DNA, 51 bp, Artificial Sequence
  Description of Artificial Sequence: Synthetic oligonucleotide
gctcggagagaaaccacaactgtgggccgctactattacgctatggactat

SEQ ID NO: 811 - protein, 8 aa, Artificial Sequence
  Description of Artificial Sequence: Synthetic peptide
IWPGDGDT

SEQ ID NO: 812 - DNA, 24 bp, Artificial Sequence
  Description of Artificial Sequence: Synthetic oligonucleotide
atttggccaggcgacggggatact

SEQ ID NO: 813 - protein, 98 aa, Artificial Sequence; identical to SEQ ID NO: 145
  Description of Artificial Sequence: Synthetic polypeptide

SEQ ID NO: 814 - DNA, 294 bp, Artificial Sequence
  Description of Artificial Sequence: Synthetic polynucleotide
gctagcaccaaagggccttccgtgtttccactggcaccctcctctaagagcacttccggaggaaccgcagctctgggatgtctggtgaaggattacttcccagagcccgtcacagtgtcatggaacagcggagcactgaccagcggagtccacacatttcctgccgtgctgcagagttcaggcctgtattccctgagctccgtggtcacagtgccatctagttcactggggacacagacttacatctgcaacgtgaatcacaaaccatccaatactaaggtcgacaagaaagtg

SEQ ID NO: 815 - protein, 110 aa, Artificial Sequence; identical to SEQ ID NO: 147
  Description of Artificial Sequence: Synthetic polypeptide

SEQ ID NO: 816 - DNA, 330 bp, Artificial Sequence
  Description of Artificial Sequence: Synthetic polynucleotide
gctccagagctgctgggaggaccaagcgtgttcctgtttccacccaaacctaaggacactctgatgattagccgaacaccagaagtcacttgcgtggtcgtggacgtgagccacgaggaccccgaagtcaagttcaactggtacgtggatggggtcgaggtgcataatgccaaaaccaagcccagggaggaacagtataattctacataccgcgtcgtgagtgtcctgactgtgctgcaccaggactggctgaacggaaaggagtacaaatgcaaggtgtccaacaaggcactgcccgcccctatcgagaagaccatttctaaagcaaag

SEQ ID NO: 817 - protein, 106 aa, Artificial Sequence; identical to SEQ ID NO: 21
  Description of Artificial Sequence: Synthetic polypeptide

SEQ ID NO: 818 - DNA, 318 bp, Artificial Sequence
  Description of Artificial Sequence: Synthetic polynucleotide
ggccagcctcgagaaccacaggtctatgtgctgcctccaagtcgggacgagctgacaaaaaaccaggtcagcctgctgtgtctggtgaaggggttctacccctccgatattgccgtggagtgggaatctaatggacagcctgaaaacaattatctgacctggccccctgtgctggactccgatggatctttctttctgtactcaaaactgacagtggataagagcaggtggcagcagggcaacgtcttttcttgtagtgtgatgcatgaggccctgcacaatcattacacccagaaatcactgagcctgtcccccggc

SEQ ID NO: 819 - protein, 214 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 820 - DNA, 642 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacgttaacaccgctgtagcttggtatcagcagaaaccagggaaagcccctaagctcctgatctattctgcatcctttttgtacagtggggtcccatcaaggttcagtggcagtcgatctgggacagatttcactctcaccatcagcagtctgcaacctgaagattttgcaacttactactgtcaacagcattacactaccccacccactttcggccaagggaccaaagtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaagagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 821 - protein, 107 aa, Artificial Sequence [sequence omitted]

SEQ ID NO: 822 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacgttaacaccgctgtagcttggtatcagcagaaaccagggaaagcccctaagctcctgatctattctgcatcctttttgtacagtggggtcccatcaaggttcagtggcagtcgatctgggacagatttcactctcaccatcagcagtctgcaacctgaagattttgcaacttactactgtcaacagcattacactaccccacccactttcggccaagggaccaaagtggagatcaaa

SEQ ID NO: 823 - protein, 6 aa, Artificial Sequence
  Description of Artificial Sequence: Synthetic peptide
QDVNTA

SEQ ID NO: 824 - DNA, 18 bp, Artificial Sequence
  Description of Artificial Sequence: Synthetic oligonucleotide
caggacgttaacaccgct

SEQ ID NO: 825 - protein, 9 aa, Artificial Sequence
  Description of Artificial Sequence: Synthetic peptide
QQHYTTPPT

SEQ ID NO: 826 - DNA, 27 bp, Artificial Sequence
  Description of Artificial Sequence: Synthetic oligonucleotide
caacagcattacactaccccacccact

SEQ ID NO: 827 - protein, 3 aa, Artificial Sequence
  Description of Artificial Sequence: Synthetic peptide
SAS

SEQ ID NO: 828 - DNA, 9 bp, Artificial Sequence
  Description of Artificial Sequence: Synthetic oligonucleotide
tctgcatcc

SEQ ID NO: 829 - protein, 107 aa, Artificial Sequence [sequence omitted]

SEQ ID NO: 830 - DNA, 321 bp, Artificial Sequence
  Description of Artificial Sequence: Synthetic polynucleotide
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaagagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 831 - protein, 473 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 832 - DNA, 1419 bp, Artificial Sequence
  Description of Artificial Sequence: Synthetic polynucleotide
cagatcgtcctgacacagagcccagcaatcatgtcagccagccccggcgagaaagtcacaatgacttgctcagcaagctcctctgtgagctacatgaactggtatcagcagaaaagcggaacctcccccaagagatggatctacgacacatccaagctggcttctggagtgcctgcacacttcaggggcagcggctctgggaccagttattcactgacaatttccggcatggaggctgaagatgccgctacatactattgccagcagtggagttcaaacccattcacttttggatctggcaccaagctggaaattaatggcggaggaggctccggaggaggagggtctggaggaggaggaagtcaggtgcagctgcagcagtccggagctgagctggcacgaccaggagcaagtgtgaaaatgtcctgtaaggccagcggctacaccttcacacggtataccatgcattgggtgaaacagagacccgggcagggactggaatggatcgggtacattaatcctagccgaggatacacaaactacaaccagaagtttaaagacaaggctactctgaccacagataagagctcctctaccgcatatatgcagctgagttcactgacatctgaggacagtgccgtgtactattgcgctaggtactatgacgatcactactgtctggattattggggccaggggactaccctgaccgtgagctccgcagccgaacctaaatctagtgacaagactcatacctgccccccttgtccagcaccagagctgctgggaggaccttccgtgttcctgtttccacccaaaccaaaggatactctgatgatctcccggacacctgaagtcacttgcgtggtcgtggacgtgtctcacgaggaccccgaagtcaagttcaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggccctgcctgctccaatcgagaagacaattagcaaagccaaggggcagccccgagaacctcaggtctacgtgctgcctccatctcgggacgagctgactaaaaaccaggtcagtctgctgtgtctggtgaagggcttctatccaagcgatattgctgtggagtgggaatccaatgggcagcccgaaaacaattacctgacttggccccctgtcctggactcagatgggagcttctttctgtatagtaaactgaccgtggacaagtcacggtggcagcagggaaacgtctttagctgttccgtgatgcatgaggccctgcacaatcattacacccagaagtctctgagtctgtcacccggc

SEQ ID NO: 833 - protein, 106 aa, Artificial Sequence [sequence omitted]

SEQ ID NO: 834 - DNA, 318 bp, Artificial Sequence
  Description of Artificial Sequence: Synthetic polynucleotide
cagatcgtcctgacacagagcccagcaatcatgtcagccagccccggcgagaaagtcacaatgacttgctcagcaagctcctctgtgagctacatgaactggtatcagcagaaaagcggaacctcccccaagagatggatctacgacacatccaagctggcttctggagtgcctgcacacttcaggggcagcggctctgggaccagttattcactgacaatttccggcatggaggctgaagatgccgctacatactattgccagcagtggagttcaaacccattcacttttggatctggcaccaagctggaaattaat

SEQ ID NO: 835 - protein, 5 aa, Artificial Sequence
  Description of Artificial Sequence: Synthetic peptide
SSVSY

SEQ ID NO: 836 - DNA, 15 bp, Artificial Sequence
  Description of Artificial Sequence: Synthetic oligonucleotide
tcctctgtgagctac

SEQ ID NO: 837 - protein, 9 aa, Artificial Sequence
  Description of Artificial Sequence: Synthetic peptide
QQWSSNPFT

SEQ ID NO: 838 - DNA, 27 bp, Artificial Sequence
  Description of Artificial Sequence: Synthetic oligonucleotide
cagcagtggagttcaaacccattcact

SEQ ID NO: 839 - protein, 3 aa, Artificial Sequence
  Description of Artificial Sequence: Synthetic peptide
DTS

SEQ ID NO: 840 - DNA, 9 bp, Artificial Sequence
  Description of Artificial Sequence: Synthetic oligonucleotide
gacacatcc

SEQ ID NO: 841 - protein, 119 aa, Artificial Sequence [sequence omitted]

SEQ ID NO: 842 - DNA, 357 bp, Artificial Sequence
  Description of Artificial Sequence: Synthetic polynucleotide
caggtgcagctgcagcagtccggagctgagctggcacgaccaggagcaagtgtgaaaatgtcctgtaaggccagcggctacaccttcacacggtataccatgcattgggtgaaacagagacccgggcagggactggaatggatcgggtacattaatcctagccgaggatacacaaactacaaccagaagtttaaagacaaggctactctgaccacagataagagctcctctaccgcatatatgcagctgagttcactgacatctgaggacagtgccgtgtactattgcgctaggtactatgacgatcactactgtctggattattggggccaggggactaccctgaccgtgagctcc

SEQ ID NO: 843 - protein, 8 aa, Artificial Sequence
  Description of Artificial Sequence: Synthetic peptide
GYTFTRYT

SEQ ID NO: 844 - DNA, 24 bp, Artificial Sequence
  Description of Artificial Sequence: Synthetic oligonucleotide
ggctacaccttcacacggtatacc

SEQ ID NO: 845 - protein, 12 aa, Artificial Sequence
  Description of Artificial Sequence: Synthetic peptide
ARYYDDHYCLDY

SEQ ID NO: 846 - DNA, 36 bp, Artificial Sequence; identical to SEQ ID NO: 392
  Description of Artificial Sequence: Synthetic oligonucleotide

SEQ ID NO: 847 - protein, 8 aa, Artificial Sequence
  Description of Artificial Sequence: Synthetic peptide
INPSRGYT

SEQ ID NO: 848 - DNA, 24 bp, Artificial Sequence
  Description of Artificial Sequence: Synthetic oligonucleotide
attaatcctagccgaggatacaca

SEQ ID NO: 849 - protein, 110 aa, Artificial Sequence; identical to SEQ ID NO: 147
  Description of Artificial Sequence: Synthetic polypeptide

SEQ ID NO: 850 - DNA, 330 bp, Artificial Sequence
  Description of Artificial Sequence: Synthetic polynucleotide
gcaccagagctgctgggaggaccttccgtgttcctgtttccacccaaaccaaaggatactctgatgatctcccggacacctgaagtcacttgcgtggtcgtggacgtgtctcacgaggaccccgaagtcaagttcaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggccctgcctgctccaatcgagaagacaattagcaaagccaag

SEQ ID NO: 851 - protein, 106 aa, Artificial Sequence; identical to SEQ ID NO: 21
  Description of Artificial Sequence: Synthetic polypeptide

SEQ ID NO: 852 - DNA, 318 bp, Artificial Sequence
  Description of Artificial Sequence: Synthetic polynucleotide
gggcagccccgagaacctcaggtctacgtgctgcctccatctcgggacgagctgactaaaaaccaggtcagtctgctgtgtctggtgaagggcttctatccaagcgatattgctgtggagtgggaatccaatgggcagcccgaaaacaattacctgacttggccccctgtcctggactcagatgggagcttctttctgtatagtaaactgaccgtggacaagtcacggtggcagcagggaaacgtctttagctgttccgtgatgcatgaggccctgcacaatcattacacccagaagtctctgagtctgtcacccggc

SEQ ID NO: 853 - protein, 474 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 854 - DNA, 1422 bp, Artificial Sequence
  Description of Artificial Sequence: Synthetic polynucleotide
cagatcgtcctgacacagagcccagcaatcatgtcagccagccccggcgagaaagtcacaatgacttgctcagcaagctcctctgtgagctacatgaactggtatcagcagaaaagcggaacctcccccaagagatggatctacgacacatccaagctggcttctggagtgcctgcacacttcaggggcagcggctctgggaccagttattcactgacaatttccggcatggaggctgaagatgccgctacctactattgccagcagtggagttcaaacccattcacttttggatctggcaccaagctggaaattaatggcggaggaggctccggaggaggagggtctggaggaggaggaagtcaggtgcagctgcagcagagcggagctgagctggcacgaccaggagcaagtgtgaaaatgtcctgtaaggccagcggctacaccttcacacggtataccatgcattgggtgaaacagagacccgggcagggactggaatggatcgggtacattaatccttcccgaggatacacaaactacaaccagaagtttaaagacaaggctactctgaccacagataagagctcctctaccgcatatatgcagctgagttcactgacatctgaggacagtgccgtgtactattgcgctaggtactatgacgatcactactccctggattattggggccaggggactaccctgacagtgagctccgcagccgaacctaaatctagtgacaagactcatacctgccccccttgtccagcaccagagctgctgggaggacctagcgtgttcctgtttccacccaaaccaaaggatactctgatgatctcccggacacctgaagtcacttgtgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggccctgcctgctccaatcgagaagacaattagcaaagccaaggggcagccccgagaacctcaggtctacgtgctgcctccatctcgggacgagctgactaaaaaccaggtcagtctgctgtgtctggtgaagggcttctatccaagcgatattgctgtggagtgggaatccaatgggcagcccgaaaacaattacctgacttggccccctgtcctggactcagatgggagcttctttctgtatagtaaactgaccgtggacaagtcacggtggcagcagggaaacgtctttagctgttccgtgatgcatgaggccctgcacaatcattacacccagaaatctctgagtctgtcacccggcaag

SEQ ID NO: 855 - protein, 106 aa, Artificial Sequence [sequence omitted]

SEQ ID NO: 856 - DNA, 318 bp, Artificial Sequence; identical to SEQ ID NO: 380
  Description of Artificial Sequence: Synthetic polynucleotide

SEQ ID NO: 857 - protein, 5 aa, Artificial Sequence
  Description of Artificial Sequence: Synthetic peptide
SSVSY

SEQ ID NO: 858 - DNA, 15 bp, Artificial Sequence
  Description of Artificial Sequence: Synthetic oligonucleotide
tcctctgtgagctac

SEQ ID NO: 859 - protein, 9 aa, Artificial Sequence
  Description of Artificial Sequence: Synthetic peptide
QQWSSNPFT

SEQ ID NO: 860 - DNA, 27 bp, Artificial Sequence
  Description of Artificial Sequence: Synthetic oligonucleotide
cagcagtggagttcaaacccattcact

SEQ ID NO: 861 - protein, 3 aa, Artificial Sequence
  Description of Artificial Sequence: Synthetic peptide
DTS

SEQ ID NO: 862 - DNA, 9 bp, Artificial Sequence
  Description of Artificial Sequence: Synthetic oligonucleotide
gacacatcc

SEQ ID NO: 863 - protein, 119 aa, Artificial Sequence; identical to SEQ ID NO: 33
  Description of Artificial Sequence: Synthetic polypeptide

SEQ ID NO: 864 - DNA, 357 bp, Artificial Sequence
  Description of Artificial Sequence: Synthetic polynucleotide
caggtgcagctgcagcagagcggagctgagctggcacgaccaggagcaagtgtgaaaatgtcctgtaaggccagcggctacaccttcacacggtataccatgcattgggtgaaacagagacccgggcagggactggaatggatcgggtacattaatccttcccgaggatacacaaactacaaccagaagtttaaagacaaggctactctgaccacagataagagctcctctaccgcatatatgcagctgagttcactgacatctgaggacagtgccgtgtactattgcgctaggtactatgacgatcactactccctggattattggggccaggggactaccctgacagtgagctcc

SEQ ID NO: 865 - protein, 8 aa, Artificial Sequence
  Description of Artificial Sequence: Synthetic peptide
GYTFTRYT

SEQ ID NO: 866 - DNA, 24 bp, Artificial Sequence
  Description of Artificial Sequence: Synthetic oligonucleotide
ggctacaccttcacacggtatacc

SEQ ID NO: 867 - protein, 12 aa, Artificial Sequence
  Description of Artificial Sequence: Synthetic peptide
ARYYDDHYSLDY

SEQ ID NO: 868 - DNA, 36 bp, Artificial Sequence; identical to SEQ ID NO: 470
  Description of Artificial Sequence: Synthetic oligonucleotide

SEQ ID NO: 869 - protein, 8 aa, Artificial Sequence
  Description of Artificial Sequence: Synthetic peptide
INPSRGYT

SEQ ID NO: 870 - DNA, 24 bp, Artificial Sequence
  Description of Artificial Sequence: Synthetic oligonucleotide
attaatccttcccgaggatacaca

SEQ ID NO: 871 - protein, 110 aa, Artificial Sequence; identical to SEQ ID NO: 147
  Description of Artificial Sequence: Synthetic polypeptide

SEQ ID NO: 872 - DNA, 330 bp, Artificial Sequence
  Description of Artificial Sequence: Synthetic polynucleotide
gcaccagagctgctgggaggacctagcgtgttcctgtttccacccaaaccaaaggatactctgatgatctcccggacacctgaagtcacttgtgtggtcgtggacgtgtctcacgaggaccccgaagtcaagtttaactggtacgtggacggcgtcgaggtgcataatgccaaaaccaagcccagggaggaacagtacaactccacatatcgcgtcgtgtctgtcctgactgtgctgcaccaggattggctgaacggcaaggagtacaaatgcaaggtgagcaacaaggccctgcctgctccaatcgagaagacaattagcaaagccaag

SEQ ID NO: 873 - protein, 106 aa, Artificial Sequence; identical to SEQ ID NO: 21
  Description of Artificial Sequence: Synthetic polypeptide

SEQ ID NO: 874 - DNA, 318 bp, Artificial Sequence; identical to SEQ ID NO: 22
  Description of Artificial Sequence: Synthetic polynucleotide

SEQ ID NO: 875 - protein, 483 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 876 - DNA, 1449 bp, Artificial Sequence
  Description of Artificial Sequence: Synthetic polynucleotide
gaagtccagctggtcgagtccggaggaggactggtgcagccaggagggtcactgaaactgagctgcgccgcttccggcttcacttttaacaagtatgcaatgaattgggtgcggcaggcaccagggaagggactggaatgggtggcccggatcagatctaagtacaacaactacgctacctactatgcagacagtgtgaaggataggttcacaatttctcgcgacgatagtaaaaacactgcttacctgcagatgaacaatctgaagacagaggacactgcagtctactattgcgtgagacacggaaactttggcaatagctacatctcctattgggcatactggggacagggaaccctggtcacagtgagctccggaggaggaggcagcggaggaggaggctctgggggaggcgggagtcagactgtggtcacccaggagccctcactgacagtcagccctggaggcactgtgaccctgacatgtgggtctagtaccggagccgtgacatctggcaactatcccaattgggtgcagcagaaacctggacaggctccacgaggactgattggaggaacaaagttcctggcccccggaactcctgctcgattttccggctctctgctgggagggaaagcagcactgaccctgagcggagtgcagcctgaggatgaagccgagtactattgcgtgctgtggtacagcaacagatgggtgttcggaggcgggacaaagctgactgtgctggctgcagagccaaagtcaagcgacaaaactcacacctgcccaccttgtccagctccagaagcagctggaggaccatccgtgttcctgtttccacccaagcccaaagatacactgatgatctctcgcactcccgaggtcacctgtgtggtcgtgagtgtgtcacacgaagaccctgaggtcaagtttaactggtacgtggatggcgtcgaagtgcataatgccaagaccaaacctcgagaggaacagtataattcaacttaccgggtcgtgagcgtcctgaccgtgctgcatcaggactggctgaacggaaaggagtacaagtgcaaagtgagcaataaggcactgcctgccccaatcgaaaaaaccattagcaaggctaaagggcagccaagagagccccaggtctacgtgtatcctccaagcagggacgaactgaccaagaaccaggtctccctgacatgtctggtgaaagggttctatcctagtgatattgcagtggaatgggagtcaaatggacagccagagaacaattacaagaccacaccccctgtgctggactctgatggcagtttcgcactggtctccaagctgaccgtggataaatctaggtggcagcaggggaacgtctttagctgttccgtgatgcatgaagccctgcacaatcattacacacagaagtctctgagtctgtcacccggcaaa

SEQ ID NO: 877 - protein, 125 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 878 - DNA, 375 bp, Artificial Sequence
  Description of Artificial Sequence: Synthetic polynucleotide
gaagtccagctggtcgagtccggaggaggactggtgcagccaggagggtcactgaaactgagctgcgccgcttccggcttcacttttaacaagtatgcaatgaattgggtgcggcaggcaccagggaagggactggaatgggtggcccggatcagatctaagtacaacaactacgctacctactatgcagacagtgtgaaggataggttcacaatttctcgcgacgatagtaaaaacactgcttacctgcagatgaacaatctgaagacagaggacactgcagtctactattgcgtgagacacggaaactttggcaatagctacatctcctattgggcatactggggacagggaaccctggtcacagtgagctcc

SEQ ID NO: 879 - protein, 8 aa, Artificial Sequence
  Description of Artificial Sequence: Synthetic peptide
GFTFNKYA

SEQ ID NO: 880 - DNA, 24 bp, Artificial Sequence
  Description of Artificial Sequence: Synthetic oligonucleotide
ggcttcacttttaacaagtatgca

SEQ ID NO: 881 - protein, 16 aa, Artificial Sequence
  Description of Artificial Sequence: Synthetic peptide
VRHGNFGNSYISYWAY

SEQ ID NO: 882 - DNA, 48 bp, Artificial Sequence
  Description of Artificial Sequence: Synthetic oligonucleotide
gtgagacacggaaactttggcaatagctacatctcctattgggcatac

SEQ ID NO: 883 - protein, 10 aa, Artificial Sequence
  Description of Artificial Sequence: Synthetic peptide
IRSKYNNYAT

SEQ ID NO: 884 - DNA, 30 bp, Artificial Sequence
  Description of Artificial Sequence: Synthetic oligonucleotide
atcagatctaagtacaacaactacgctacc

SEQ ID NO: 885 - protein, 109 aa, Artificial Sequence
  Description of Artificial Sequence: Synthetic polypeptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 886 - DNA, 327 bp, Artificial Sequence
  Description of Artificial Sequence: Synthetic polynucleotide
cagactgtggtcacccaggagccctcactgacagtcagccctggaggcactgtgaccctgacatgtgggtctagtaccggagccgtgacatctggcaactatcccaattgggtgcagcagaaacctggacaggctccacgaggactgattggaggaacaaagttcctggcccccggaactcctgctcgattttccggctctctgctgggagggaaagcagcactgaccctgagcggagtgcagcctgaggatgaagccgagtactattgcgtgctgtggtacagcaacagatgggtgttcggaggcgggacaaagctgactgtgctg

SEQ ID NO: 887 - protein, 9 aa, Artificial Sequence
  Description of Artificial Sequence: Synthetic peptide
TGAVTSGNY

SEQ ID NO: 888 - DNA, 27 bp, Artificial Sequence
  Description of Artificial Sequence: Synthetic oligonucleotide
accggagccgtgacatctggcaactat

SEQ ID NO: 889 - protein, 9 aa, Artificial Sequence
  Description of Artificial Sequence: Synthetic peptide
VLWYSNRWV

SEQ ID NO: 890 - DNA, 27 bp, Artificial Sequence
  Description of Artificial Sequence: Synthetic oligonucleotide
gtgctgtggtacagcaacagatgggtg

SEQ ID NO: 891 - protein, 3 aa, Artificial Sequence
  Description of Artificial Sequence: Synthetic peptide
GTK

SEQ ID NO: 892 - DNA, 9 bp, Artificial Sequence
  Description of Artificial Sequence: Synthetic oligonucleotide
ggaacaaag

SEQ ID NO: 893 - protein, 110 aa, Artificial Sequence; identical to SEQ ID NO: 19
  Description of Artificial Sequence: Synthetic polypeptide

SEQ ID NO: 894 - DNA, 330 bp, Artificial Sequence
  Description of Artificial Sequence: Synthetic polynucleotide
gctccagaagcagctggaggaccatccgtgttcctgtttccacccaagcccaaagatacactgatgatctctcgcactcccgaggtcacctgtgtggtcgtgagtgtgtcacacgaagaccctgaggtcaagtttaactggtacgtggatggcgtcgaagtgcataatgccaagaccaaacctcgagaggaacagtataattcaacttaccgggtcgtgagcgtcctgaccgtgctgcatcaggactggctgaacggaaaggagtacaagtgcaaagtgagcaataaggcactgcctgccccaatcgaaaaaaccattagcaaggctaaa

SEQ ID NO: 895 - protein, 106 aa, Artificial Sequence; identical to SEQ ID NO: 89
  Description of Artificial Sequence: Synthetic polypeptide

SEQ ID NO: 896 - DNA, 318 bp, Artificial Sequence
  Description of Artificial Sequence: Synthetic polynucleotide
gggcagccaagagagccccaggtctacgtgtatcctccaagcagggacgaactgaccaagaaccaggtctccctgacatgtctggtgaaagggttctatcctagtgatattgcagtggaatgggagtcaaatggacagccagagaacaattacaagaccacaccccctgtgctggactctgatggcagtttcgcactggtctccaagctgaccgtggataaatctaggtggcagcaggggaacgtctttagctgttccgtgatgcatgaagccctgcacaatcattacacacagaagtctctgagtctgtcacccggc

SEQ ID NO: 897 - protein, 453 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 898 - DNA, 1359 bp, Artificial Sequence
  Description of Artificial Sequence: Synthetic polynucleotide
caggtccagctgcagcagagcggagccgaactggtcagacccggcagctccgtgaaaatcagttgcaaggcttcaggctatgcattctctagttactggatgaactgggtgaagcagaggcctgggcagggactggaatggatcgggcagatttggccaggcgacggggatacaaactataatgggaagttcaaaggaaaggccacactgactgctgacgagtcaagctccactgcatatatgcagctgtctagtctggcatctgaggatagtgccgtgtacttttgcgctcggagagaaaccacaactgtgggccgctactattacgccatggactattggggacagggcaccacagtcacagtgtcaagcgctagcactaaagggccttccgtgtttccactggcaccctcctctaagagcacatccggaggaactgcagctctgggatgtctggtgaaggattacttcccagagcccgtcacagtgtcatggaacagcggcgcactgactagcggggtccacacctttcctgccgtgctgcagagttcaggcctgtattccctgagctccgtggtcaccgtgccatctagttcactggggacccagacatacatctgcaacgtgaatcacaaaccatccaatacaaaggtcgacaagaaagtggaacccaaatcttgtgataagactcatacctgccccccttgtcctgctccagagctgctgggaggaccaagcgtgttcctgtttccacccaaacctaaggacacactgatgattagccgaaccccagaagtgacatgcgtggtcgtggacgtgagccacgaggaccccgaagtcaaattcaactggtacgtggatggggtcgaggtgcataatgccaaaaccaagcccagggaggaacagtataattctacttaccgcgtcgtgagtgtcctgaccgtgctgcaccaggactggctgaacggaaaggagtacaaatgcaaggtgtccaacaaggcactgcccgcccctatcgagaagaccatttctaaagctaagggccagcctcgagaaccacaggtctatgtgtaccctccaagtcgggacgagctgaccaaaaaccaggtcagcctgacatgtctggtgaaggggttttatccctccgatattgcagtggagtgggaatctaatggacagcctgaaaacaattacaagactaccccccctgtgctggactccgatggatctttcgccctggtctcaaaactgactgtggataagagcaggtggcagcagggcaacgtcttttcttgtagtgtgatgcatgaggctctgcacaatcattacacccagaagtcactgagcctgtcccccggc

SEQ ID NO: 899 - protein, 124 aa, Artificial Sequence; identical to SEQ ID NO: 79
  Description of Artificial Sequence: Synthetic polypeptide

SEQ ID NO: 900 - DNA, 372 bp, Artificial Sequence
  Description of Artificial Sequence: Synthetic polynucleotide
caggtccagctgcagcagagcggagccgaactggtcagacccggcagctccgtgaaaatcagttgcaaggcttcaggctatgcattctctagttactggatgaactgggtgaagcagaggcctgggcagggactggaatggatcgggcagatttggccaggcgacggggatacaaactataatgggaagttcaaaggaaaggccacactgactgctgacgagtcaagctccactgcatatatgcagctgtctagtctggcatctgaggatagtgccgtgtacttttgcgctcggagagaaaccacaactgtgggccgctactattacgccatggactattggggacagggcaccacagtcacagtgtcaagc

SEQ ID NO: 901 - protein, 8 aa, Artificial Sequence
  Description of Artificial Sequence: Synthetic peptide
GYAFSSYW

SEQ ID NO: 902 - DNA, 24 bp, Artificial Sequence
  Description of Artificial Sequence: Synthetic oligonucleotide
ggctatgcattctctagttactgg

SEQ ID NO: 903 - protein, 17 aa, Artificial Sequence
  Description of Artificial Sequence: Synthetic peptide
ARRETTTVGRYYYAMDY

SEQ ID NO: 904 - DNA, 51 bp, Artificial Sequence
  Description of Artificial Sequence: Synthetic oligonucleotide
gctcggagagaaaccacaactgtgggccgctactattacgccatggactat

SEQ ID NO: 905 - protein, 8 aa, Artificial Sequence
  Description of Artificial Sequence: Synthetic peptide
IWPGDGDT

SEQ ID NO: 906 - DNA, 24 bp, Artificial Sequence
  Description of Artificial Sequence: Synthetic oligonucleotide
atttggccaggcgacggggataca

SEQ ID NO: 907 - protein, 98 aa, Artificial Sequence; identical to SEQ ID NO: 145
  Description of Artificial Sequence: Synthetic polypeptide

SEQ ID NO: 908 - DNA, 294 bp, Artificial Sequence
  Description of Artificial Sequence: Synthetic polynucleotide
gctagcactaaagggccttccgtgtttccactggcaccctcctctaagagcacatccggaggaactgcagctctgggatgtctggtgaaggattacttcccagagcccgtcacagtgtcatggaacagcggcgcactgactagcggggtccacacctttcctgccgtgctgcagagttcaggcctgtattccctgagctccgtggtcaccgtgccatctagttcactggggacccagacatacatctgcaacgtgaatcacaaaccatccaatacaaaggtcgacaagaaagtg

SEQ ID NO: 909 - protein, 110 aa, Artificial Sequence; identical to SEQ ID NO: 147
  Description of Artificial Sequence: Synthetic polypeptide

SEQ ID NO: 910 - DNA, 330 bp, Artificial Sequence
  Description of Artificial Sequence: Synthetic polynucleotide
gctccagagctgctgggaggaccaagcgtgttcctgtttccacccaaacctaaggacacactgatgattagccgaaccccagaagtgacatgcgtggtcgtggacgtgagccacgaggaccccgaagtcaaattcaactggtacgtggatggggtcgaggtgcataatgccaaaaccaagcccagggaggaacagtataattctacttaccgcgtcgtgagtgtcctgaccgtgctgcaccaggactggctgaacggaaaggagtacaaatgcaaggtgtccaacaaggcactgcccgcccctatcgagaagaccatttctaaagctaag

SEQ ID NO: 911 - protein, 106 aa, Artificial Sequence; identical to SEQ ID NO: 89
  Description of Artificial Sequence: Synthetic polypeptide

SEQ ID NO: 912 - DNA, 318 bp, Artificial Sequence
  Description of Artificial Sequence: Synthetic polynucleotide
ggccagcctcgagaaccacaggtctatgtgtaccctccaagtcgggacgagctgaccaaaaaccaggtcagcctgacatgtctggtgaaggggttttatccctccgatattgcagtggagtgggaatctaatggacagcctgaaaacaattacaagactaccccccctgtgctggactccgatggatctttcgccctggtctcaaaactgactgtggataagagcaggtggcagcagggcaacgtcttttcttgtagtgtgatgcatgaggctctgcacaatcattacacccagaagtcactgagcctgtcccccggc

SEQ ID NO: 913 - protein, 453 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 914 - DNA, 1359 bp, Artificial Sequence
  Description of Artificial Sequence: Synthetic polynucleotide
caggtccagctgcagcagtccggagccgaactggtcagacccggcagctccgtgaaaatcagctgcaaggcctccggctatgctttctctagttactggatgaactgggtgaagcagaggcctgggcagggactggaatggatcgggcagatttggccaggcgacggggatacaaactataatgggaagttcaaaggaaaggcaacactgactgccgacgagtcaagctccactgcttatatgcagctgtctagtctggcttcagaggatagcgcagtgtacttttgcgcccggagagaaaccacaactgtgggccgctactattacgcaatggactattggggacagggcaccacagtcacagtgtcaagcgcctctactaaagggcctagtgtgtttccactggctccctcctctaagagcacatccggaggaactgcagctctgggatgtctggtgaaggattacttcccagagcccgtcacagtgtcctggaactctggcgctctgactagcggggtccacacctttcctgcagtgctgcagagttcaggcctgtatagcctgagctccgtggtcaccgtgccatctagttcactggggacccagacatacatctgcaacgtgaatcacaaaccaagcaatacaaaggtcgacaagaaagtggaacccaaaagctgtgataagactcatacctgccccccttgtcctgcaccagaggcagcaggaggaccaagcgtgttcctgtttccacccaaacctaaggacacactgatgatttcccgaaccccagaagtgacatgcgtggtcgtgtctgtgagtcacgaggaccccgaagtcaaattcaactggtacgtggatggggtcgaggtgcataatgccaaaaccaagcccagggaggaacagtataattcaacttaccgcgtcgtgagcgtcctgaccgtgctgcaccaggattggctgaacggaaaggagtacaaatgcaaggtgtccaacaaggctctgcccgcacctatcgagaagaccatttctaaagctaagggccagcctcgagaaccacaggtctatgtgtaccctccatcccgggacgagctgaccaaaaaccaggtctctctgacatgtctggtgaaggggttttatcccagtgatattgccgtggagtgggaaagcaatggacagcctgaaaacaattacaagactaccccccctgtgctggacagtgatggatcattcgcactggtctccaaactgactgtggacaagtctaggtggcagcagggcaacgtcttttcatgtagcgtgatgcatgaggccctgcacaatcattacacccagaagtccctgtctctgagtcccggc

SEQ ID NO: 915 - protein, 124 aa, Artificial Sequence; identical to SEQ ID NO: 79
  Description of Artificial Sequence: Synthetic polypeptide

SEQ ID NO: 916 - DNA, 372 bp, Artificial Sequence
  Description of Artificial Sequence: Synthetic polynucleotide
caggtccagctgcagcagtccggagccgaactggtcagacccggcagctccgtgaaaatcagctgcaaggcctccggctatgctttctctagttactggatgaactgggtgaagcagaggcctgggcagggactggaatggatcgggcagatttggccaggcgacggggatacaaactataatgggaagttcaaaggaaaggcaacactgactgccgacgagtcaagctccactgcttatatgcagctgtctagtctggcttcagaggatagcgcagtgtacttttgcgcccggagagaaaccacaactgtgggccgctactattacgcaatggactattggggacagggcaccacagtcacagtgtcaagc

SEQ ID NO: 917 - protein, 8 aa, Artificial Sequence
  Description of Artificial Sequence: Synthetic peptide
GYAFSSYW

SEQ ID NO: 918 - DNA, 24 bp, Artificial Sequence
  Description of Artificial Sequence: Synthetic oligonucleotide
ggctatgctttctctagttactgg

SEQ ID NO: 919 - protein, 17 aa, Artificial Sequence
  Description of Artificial Sequence: Synthetic peptide
ARRETTTVGRYYYAMDY

SEQ ID NO: 920 - DNA, 51 bp, Artificial Sequence
  Description of Artificial Sequence: Synthetic oligonucleotide
gcccggagagaaaccacaactgtgggccgctactattacgcaatggactat

SEQ ID NO: 921 - protein, 8 aa, Artificial Sequence
  Description of Artificial Sequence: Synthetic peptide
IWPGDGDT

SEQ ID NO: 922 - DNA, 24 bp, Artificial Sequence
  Description of Artificial Sequence: Synthetic oligonucleotide
atttggccaggcgacggggataca

SEQ ID NO: 923 - protein, 98 aa, Artificial Sequence; identical to SEQ ID NO: 145
  Description of Artificial Sequence: Synthetic polypeptide

SEQ ID NO: 924 - DNA, 294 bp, Artificial Sequence
  Description of Artificial Sequence: Synthetic polynucleotide
gcctctactaaagggcctagtgtgtttccactggctccctcctctaagagcacatccggaggaactgcagctctgggatgtctggtgaaggattacttcccagagcccgtcacagtgtcctggaactctggcgctctgactagcggggtccacacctttcctgcagtgctgcagagttcaggcctgtatagcctgagctccgtggtcaccgtgccatctagttcactggggacccagacatacatctgcaacgtgaatcacaaaccaagcaatacaaaggtcgacaagaaagtg

SEQ ID NO: 925 - protein, 110 aa, Artificial Sequence; identical to SEQ ID NO: 19
  Description of Artificial Sequence: Synthetic polypeptide

SEQ ID NO: 926 - DNA, 330 bp, Artificial Sequence
  Description of Artificial Sequence: Synthetic polynucleotide
gcaccagaggcagcaggaggaccaagcgtgttcctgtttccacccaaacctaaggacacactgatgatttcccgaaccccagaagtgacatgcgtggtcgtgtctgtgagtcacgaggaccccgaagtcaaattcaactggtacgtggatggggtcgaggtgcataatgccaaaaccaagcccagggaggaacagtataattcaacttaccgcgtcgtgagcgtcctgaccgtgctgcaccaggattggctgaacggaaaggagtacaaatgcaaggtgtccaacaaggctctgcccgcacctatcgagaagaccatttctaaagctaag

SEQ ID NO: 927 - protein, 106 aa, Artificial Sequence; identical to SEQ ID NO: 89
  Description of Artificial Sequence: Synthetic polypeptide

SEQ ID NO: 928 - DNA, 318 bp, Artificial Sequence
  Description of Artificial Sequence: Synthetic polynucleotide
ggccagcctcgagaaccacaggtctatgtgtaccctccatcccgggacgagctgaccaaaaaccaggtctctctgacatgtctggtgaaggggttttatcccagtgatattgccgtggagtgggaaagcaatggacagcctgaaaacaattacaagactaccccccctgtgctggacagtgatggatcattcgcactggtctccaaactgactgtggacaagtctaggtggcagcagggcaacgtcttttcatgtagcgtgatgcatgaggccctgcacaatcattacacccagaagtccctgtctctgagtcccggc

SEQ ID NO: 929 - protein, 483 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGCGTKLEIKGGGGSGGGGSGGGGSQVQLQQSGAELVRPGSSVKISCKASGYAFSSYWMNWVKQRPGQCLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 930 - DNA, 1449 bp, Artificial Sequence
  Description of Artificial Sequence: Synthetic polynucleotide
gatattcagctgactcagagtcctgcttcactggcagtgagcctgggacagcgagcaaccatctcctgcaaagctagtcagtcagtggactatgatggagactcctatctgaactggtaccagcagatcccaggccagccccctaagctgctgatctacgacgcctcaaatctggtgagcggcatcccaccacgattcagcggcagcggctctgggactgattttaccctgaacattcacccagtcgagaaggtggacgccgctacataccattgccagcagtctaccgaggacccctggacattcggatgtggcactaaactggaaatcaagggaggaggaggcagtggcggaggagggtcaggaggaggaggaagccaggtgcagctgcagcagagcggagcagagctggtcagaccaggaagctccgtgaaaatttcctgcaaggcatctggctatgccttttctagttactggatgaattgggtgaagcagaggccaggccagtgtctggaatggatcgggcagatttggcccggggatggagacacaaactataatggaaagttcaaaggcaaggctacactgactgcagacgagtcaagctccactgcttatatgcagctgtctagtctggccagcgaggattccgctgtgtacttttgcgcacggagagaaaccacaactgtgggcaggtactattacgcaatggactactggggccaggggaccacagtcaccgtgtcaagcgcagccgaacccaaatcctctgataagacccacacatgccctccatgtccagcacctgagctgctgggaggaccaagcgtgttcctgtttccacctaaacctaaggacactctgatgatctctcggacacccgaagtcacttgtgtggtcgtggatgtgagccacgaggaccctgaagtcaaattcaactggtacgtggatggcgtcgaggtgcataatgccaaaacaaagcctagggaggaacagtataactccacttaccgcgtcgtgtctgtcctgaccgtgctgcatcaggactggctgaacggaaaggagtacaaatgcaaggtgagcaacaaggccctgccagctcccatcgagaagaccatttccaaagctaagggccagcctcgagaaccacaggtctatgtgtacccacccagccgggacgagctgaccaaaaaccaggtctccctgacatgtctggtgaaggggttttatccttctgatattgccgtggagtgggaaagtaatggacagccagaaaacaattacaaaactacccctccagtgctggattctgacggcagtttcgcactggtcagtaaactgaccgtggataagtcacggtggcagcaggggaacgtctttagttgttcagtgatgcacgaggccctgcacaatcattacacacagaagagcctgtccctgtctcccggc

SEQ ID NO: 931 - protein, 111 aa, Artificial Sequence; identical to SEQ ID NO: 279
  Description of Artificial Sequence: Synthetic polypeptide

SEQ ID NO: 932 - DNA, 333 bp, Artificial Sequence
  Description of Artificial Sequence: Synthetic polynucleotide
gatattcagctgactcagagtcctgcttcactggcagtgagcctgggacagcgagcaaccatctcctgcaaagctagtcagtcagtggactatgatggagactcctatctgaactggtaccagcagatcccaggccagccccctaagctgctgatctacgacgcctcaaatctggtgagcggcatcccaccacgattcagcggcagcggctctgggactgattttaccctgaacattcacccagtcgagaaggtggacgccgctacataccattgccagcagtctaccgaggacccctggacattcggatgtggcactaaactggaaatcaag

SEQ ID NO: 933 - protein, 10 aa, Artificial Sequence
  Description of Artificial Sequence: Synthetic peptide
QSVDYDGDSY

SEQ ID NO: 934 - DNA, 30 bp, Artificial Sequence
  Description of Artificial Sequence: Synthetic oligonucleotide
cagtcagtggactatgatggagactcctat

SEQ ID NO: 935 - protein, 9 aa, Artificial Sequence
  Description of Artificial Sequence: Synthetic peptide
QQSTEDPWT

SEQ ID NO: 936 - DNA, 27 bp, Artificial Sequence
  Description of Artificial Sequence: Synthetic oligonucleotide
cagcagtctaccgaggacccctggaca

SEQ ID NO: 937 - protein, 3 aa, Artificial Sequence
  Description of Artificial Sequence: Synthetic peptide
DAS

SEQ ID NO: 938 - DNA, 9 bp, Artificial Sequence
  Description of Artificial Sequence: Synthetic oligonucleotide
gacgcctca

SEQ ID NO: 939 - protein, 124 aa, Artificial Sequence; identical to SEQ ID NO: 287
  Description of Artificial Sequence: Synthetic polypeptide

SEQ ID NO: 940 - DNA, 372 bp, Artificial Sequence
  Description of Artificial Sequence: Synthetic polynucleotide
caggtgcagctgcagcagagcggagcagagctggtcagaccaggaagctccgtgaaaatttcctgcaaggcatctggctatgccttttctagttactggatgaattgggtgaagcagaggccaggccagtgtctggaatggatcgggcagatttggcccggggatggagacacaaactataatggaaagttcaaaggcaaggctacactgactgcagacgagtcaagctccactgcttatatgcagctgtctagtctggccagcgaggattccgctgtgtacttttgcgcacggagagaaaccacaactgtgggcaggtactattacgcaatggactactggggccaggggaccacagtcaccgtgtcaagc

SEQ ID NO: 941 - protein, 8 aa, Artificial Sequence
  Description of Artificial Sequence: Synthetic peptide
GYAFSSYW

SEQ ID NO: 942 - DNA, 24 bp, Artificial Sequence
  Description of Artificial Sequence: Synthetic oligonucleotide
ggctatgccttttctagttactgg

SEQ ID NO: 943 - protein, 17 aa, Artificial Sequence
  Description of Artificial Sequence: Synthetic peptide
ARRETTTVGRYYYAMDY

SEQ ID NO: 944 - DNA, 51 bp, Artificial Sequence; identical to SEQ ID NO: 348
  Description of Artificial Sequence: Synthetic oligonucleotide

SEQ ID NO: 945 - protein, 8 aa, Artificial Sequence
  Description of Artificial Sequence: Synthetic peptide
IWPGDGDT

SEQ ID NO: 946 - DNA, 24 bp, Artificial Sequence
  Description of Artificial Sequence: Synthetic oligonucleotide
atttggcccggggatggagacaca

SEQ ID NO: 947 - protein, 110 aa, Artificial Sequence; identical to SEQ ID NO: 147
  Description of Artificial Sequence: Synthetic polypeptide

SEQ ID NO: 948 - DNA, 330 bp, Artificial Sequence
  Description of Artificial Sequence: Synthetic polynucleotide
gcacctgagctgctgggaggaccaagcgtgttcctgtttccacctaaacctaaggacactctgatgatctctcggacacccgaagtcacttgtgtggtcgtggatgtgagccacgaggaccctgaagtcaaattcaactggtacgtggatggcgtcgaggtgcataatgccaaaacaaagcctagggaggaacagtataactccacttaccgcgtcgtgtctgtcctgaccgtgctgcatcaggactggctgaacggaaaggagtacaaatgcaaggtgagcaacaaggccctgccagctcccatcgagaagaccatttccaaagctaag

SEQ ID NO: 949 - protein, 106 aa, Artificial Sequence; identical to SEQ ID NO: 89
  Description of Artificial Sequence: Synthetic polypeptide

SEQ ID NO: 950 - DNA, 318 bp, Artificial Sequence
  Description of Artificial Sequence: Synthetic polynucleotide
ggccagcctcgagaaccacaggtctatgtgtacccacccagccgggacgagctgaccaaaaaccaggtctccctgacatgtctggtgaaggggttttatccttctgatattgccgtggagtgggaaagtaatggacagccagaaaacaattacaaaactacccctccagtgctggattctgacggcagtttcgcactggtcagtaaactgaccgtggataagtcacggtggcagcaggggaacgtctttagttgttcagtgatgcacgaggccctgcacaatcattacacacagaagagcctgtccctgtctcccggc

SEQ ID NO: 951 - protein, 480 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSSSTGGGGSGGGGSGGGGSDIQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 952 - DNA, 1440 bp, Artificial Sequence
  Description of Artificial Sequence: Synthetic polynucleotide
caggtccagctgcagcagagcggagctgagctggcacgaccaggagcaagtgtgaaaatgtcatgcaaggccagcggctacaccttcacacggtatactatgcactgggtgaaacagagacccggacagggcctggaatggatcgggtacattaaccctagccgaggatacaccaactacaaccagaagtttaaagacaaggctaccctgaccacagataagagctcctctacagcatatatgcagctgagttcactgacttctgaggacagtgctgtgtactattgtgcacggtactatgacgatcattactccctggattattgggggcagggaactaccctgaccgtgagctcctctagtacaggaggaggaggcagtggaggaggagggtcaggcggaggaggaagcgacatccagattgtgctgacacagtctccagcaatcatgtccgcctctcccggcgagaaagtcactatgacctgctccgcctcaagctccgtgtcttacatgaattggtatcagcagaaatcaggaaccagccccaagagatggatctacgacacatccaagctggcctctggcgtgcctgctcacttcaggggcagtgggtcaggaactagctattccctgaccattagcggcatggaggccgaagatgccgctacctactattgtcagcagtggtctagtaacccattcacatttggcagcgggactaagctggagatcaatagggcagccgaacccaaatcaagcgacaagacacatacttgccccccttgtccagcaccagaactgctgggaggaccttccgtgttcctgtttccacccaaaccaaaggatacactgatgattagccgcacccctgaggtcacatgcgtggtcgtggacgtgagccacgaggaccccgaagtcaagttcaactggtacgtggacggcgtcgaagtgcataatgccaaaaccaagcctagggaggaacagtacaacagtacatatagagtcgtgtcagtgctgaccgtcctgcaccaggattggctgaacggcaaggagtacaaatgcaaggtgtccaacaaggccctgcctgctccaatcgagaagaccatttctaaagcaaaggggcagccccgagaacctcaggtctacgtgtatcctccatcccgggacgagctgactaaaaaccaggtctctctgacctgtctggtgaagggcttttacccatctgatattgctgtcgagtgggaaagtaatgggcagcccgagaacaattataagacaactccccctgtgctggactccgatgggtctttcgccctggtcagcaaactgacagtggataagtccagatggcagcagggaaacgtcttttcttgtagtgtgatgcatgaagctctgcacaatcattacactcagaaatcactgagcctgtcccccggcaag

SEQ ID NO: 953 - protein, 119 aa, Artificial Sequence; identical to SEQ ID NO: 33
  Description of Artificial Sequence: Synthetic polypeptide

SEQ ID NO: 954 - DNA, 357 bp, Artificial Sequence
  Description of Artificial Sequence: Synthetic polynucleotide
caggtccagctgcagcagagcggagctgagctggcacgaccaggagcaagtgtgaaaatgtcatgcaaggccagcggctacaccttcacacggtatactatgcactgggtgaaacagagacccggacagggcctggaatggatcgggtacattaaccctagccgaggatacaccaactacaaccagaagtttaaagacaaggctaccctgaccacagataagagctcctctacagcatatatgcagctgagttcactgacttctgaggacagtgctgtgtactattgtgcacggtactatgacgatcattactccctggattattgggggcagggaactaccctgaccgtgagctcc

SEQ ID NO: 955 - protein, 8 aa, Artificial Sequence
  Description of Artificial Sequence: Synthetic peptide
GYTFTRYT

SEQ ID NO: 956 - DNA, 24 bp, Artificial Sequence
  Description of Artificial Sequence: Synthetic oligonucleotide
ggctacaccttcacacggtatact

SEQ ID NO: 957 - protein, 12 aa, Artificial Sequence
  Description of Artificial Sequence: Synthetic peptide
ARYYDDHYSLDY

SEQ ID NO: 958 - DNA, 36 bp, Artificial Sequence
  Description of Artificial Sequence: Synthetic oligonucleotide
gcacggtactatgacgatcattactccctggattat

SEQ ID NO: 959 - protein, 8 aa, Artificial Sequence
  Description of Artificial Sequence: Synthetic peptide
INPSRGYT

SEQ ID NO: 960 - DNA, 24 bp, Artificial Sequence
  Description of Artificial Sequence: Synthetic oligonucleotide
attaaccctagccgaggatacacc

SEQ ID NO: 961 - protein, 106 aa, Artificial Sequence [sequence omitted]

SEQ ID NO: 962 - DNA, 318 bp, Artificial Sequence
  Description of Artificial Sequence: Synthetic polynucleotide
cagattgtgctgacacagtctccagcaatcatgtccgcctctcccggcgagaaagtcactatgacctgctccgcctcaagctccgtgtcttacatgaattggtatcagcagaaatcaggaaccagccccaagagatggatctacgacacatccaagctggcctctggcgtgcctgctcacttcaggggcagtgggtcaggaactagctattccctgaccattagcggcatggaggccgaagatgccgctacctactattgtcagcagtggtctagtaacccattcacatttggcagcgggactaagctggagatcaat

SEQ ID NO: 963 - protein, 5 aa, Artificial Sequence
  Description of Artificial Sequence: Synthetic peptide
SSVSY

SEQ ID NO: 964 - DNA, 15 bp, Artificial Sequence
  Description of Artificial Sequence: Synthetic oligonucleotide
agctccgtgtcttac

SEQ ID NO: 965 - protein, 9 aa, Artificial Sequence
  Description of Artificial Sequence: Synthetic peptide
QQWSSNPFT

SEQ ID NO: 966 - DNA, 27 bp, Artificial Sequence
  Description of Artificial Sequence: Synthetic oligonucleotide
cagcagtggtctagtaacccattcaca

SEQ ID NO: 967 - protein, 3 aa, Artificial Sequence
  Description of Artificial Sequence: Synthetic peptide
DTS

SEQ ID NO: 968 - DNA, 9 bp, Artificial Sequence
  Description of Artificial Sequence: Synthetic oligonucleotide
gacacatcc

SEQ ID NO: 969 - protein, 110 aa, Artificial Sequence; identical to SEQ ID NO: 147
  Description of Artificial Sequence: Synthetic polypeptide

SEQ ID NO: 970 - DNA, 330 bp, Artificial Sequence
  Description of Artificial Sequence: Synthetic polynucleotide
gcaccagaactgctgggaggaccttccgtgttcctgtttccacccaaaccaaaggatacactgatgattagccgcacccctgaggtcacatgcgtggtcgtggacgtgagccacgaggaccccgaagtcaagttcaactggtacgtggacggcgtcgaagtgcataatgccaaaaccaagcctagggaggaacagtacaacagtacatatagagtcgtgtcagtgctgaccgtcctgcaccaggattggctgaacggcaaggagtacaaatgcaaggtgtccaacaaggccctgcctgctccaatcgagaagaccatttctaaagcaaag

SEQ ID NO: 971 - protein, 106 aa, Artificial Sequence; identical to SEQ ID NO: 89
  Description of Artificial Sequence: Synthetic polypeptide

SEQ ID NO: 972 - DNA, 318 bp, Artificial Sequence
  Description of Artificial Sequence: Synthetic polynucleotide
gggcagccccgagaacctcaggtctacgtgtatcctccatcccgggacgagctgactaaaaaccaggtctctctgacctgtctggtgaagggcttttacccatctgatattgctgtcgagtgggaaagtaatgggcagcccgagaacaattataagacaactccccctgtgctggactccgatgggtctttcgccctggtcagcaaactgacagtggataagtccagatggcagcagggaaacgtcttttcttgtagtgtgatgcatgaagctctgcacaatcattacactcagaaatcactgagcctgtcccccggc

SEQ ID NO: 973 - protein, 484 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 974 - DNA, 1452 bp, Artificial Sequence
  Description of Artificial Sequence: Synthetic polynucleotide
gacattcagctgacccagagtcctgcttcactggcagtgagcctgggacagcgagcaacaatctcctgcaaagctagtcagtcagtggactatgatggcgactcctatctgaactggtaccagcagatcccagggcagccccctaagctgctgatctacgacgcctcaaatctggtgagcggcatcccaccacgattcagcggcagcggctctggaaccgattttacactgaacattcacccagtcgagaaggtggacgccgctacctaccattgccagcagtctacagaggacccctggactttcggcgggggaaccaaactggaaatcaagggaggaggaggcagtggcggaggagggtcaggaggaggaggaagccaggtgcagctgcagcagagcggagcagagctggtcagaccaggaagctccgtgaaaatttcctgtaaggcatctggctatgccttttctagttactggatgaattgggtgaagcagaggccaggacagggcctggaatggatcgggcagatttggcccggggatggagacacaaactataatggaaagttcaaaggcaaggctactctgaccgcagacgagtcaagctccactgcatatatgcagctgtctagtctggccagcgaggattccgctgtctacttttgcgcacggagagaaaccacaactgtgggcaggtactattacgccatggactactggggccaggggaccacagtcaccgtgtcaagcgcagccgaacccaaatcctctgataagacacacacttgccctccatgtccagctcctgagctgctgggaggaccaagcgtgttcctgtttccacctaaacctaaggacactctgatgatctctcggactcccgaagtcacctgtgtggtcgtggatgtgagccacgaggaccctgaagtcaaattcaactggtacgtggatggcgtcgaggtgcataatgccaaaacaaagcctagggaggaacagtataactccacataccgcgtcgtgtctgtcctgactgtgctgcatcaggactggctgaacggaaaggagtacaaatgcaaggtgagcaacaaggccctgccagctcccatcgagaagaccatttccaaagctaagggccagcctcgagaaccacaggtctatgtgctgccacccagccgggacgagctgacaaaaaaccaggtctccctgctgtgtctggtgaagggattctacccttctgatattgcagtggagtgggaaagtaatggccagccagaaaacaattatctgacttggcctccagtgctggattctgacgggagtttctttctgtacagtaaactgaccgtggataagtcacggtggcagcagggaaacgtctttagttgttcagtgatgcacgaggccctgcacaatcattacacccagaaaagcctgtccctgtctcccggcaag

SEQ ID NO: 975 - protein, 111 aa, Artificial Sequence; identical to SEQ ID NO: 59
  Description of Artificial Sequence: Synthetic polypeptide

SEQ ID NO: 976 - DNA, 333 bp, Artificial Sequence
  Description of Artificial Sequence: Synthetic polynucleotide
gacattcagctgacccagagtcctgcttcactggcagtgagcctgggacagcgagcaacaatctcctgcaaagctagtcagtcagtggactatgatggcgactcctatctgaactggtaccagcagatcccagggcagccccctaagctgctgatctacgacgcctcaaatctggtgagcggcatcccaccacgattcagcggcagcggctctggaaccgattttacactgaacattcacccagtcgagaaggtggacgccgctacctaccattgccagcagtctacagaggacccctggactttcggcgggggaaccaaactggaaatcaag

SEQ ID NO: 977 - protein, 10 aa, Artificial Sequence
  Description of Artificial Sequence: Synthetic peptide
QSVDYDGDSY

SEQ ID NO: 978 - DNA, 30 bp, Artificial Sequence; identical to SEQ ID NO: 74
  Description of Artificial Sequence: Synthetic oligonucleotide

SEQ ID NO: 979 - protein, 9 aa, Artificial Sequence
  Description of Artificial Sequence: Synthetic peptide
QQSTEDPWT

SEQ ID NO: 980 - DNA, 27 bp, Artificial Sequence
  Description of Artificial Sequence: Synthetic oligonucleotide
cagcagtctacagaggacccctggact

SEQ ID NO: 981 - protein, 3 aa, Artificial Sequence
  Description of Artificial Sequence: Synthetic peptide
DAS

SEQ ID NO: 982 - DNA, 9 bp, Artificial Sequence
  Description of Artificial Sequence: Synthetic oligonucleotide
gacgcctca

SEQ ID NO: 983 - protein, 124 aa, Artificial Sequence; identical to SEQ ID NO: 79
  Description of Artificial Sequence: Synthetic polypeptide

SEQ ID NO: 984 - DNA, 372 bp, Artificial Sequence
  Description of Artificial Sequence: Synthetic polynucleotide
caggtgcagctgcagcagagcggagcagagctggtcagaccaggaagctccgtgaaaatttcctgtaaggcatctggctatgccttttctagttactggatgaattgggtgaagcagaggccaggacagggcctggaatggatcgggcagatttggcccggggatggagacacaaactataatggaaagttcaaaggcaaggctactctgaccgcagacgagtcaagctccactgcatatatgcagctgtctagtctggccagcgaggattccgctgtctacttttgcgcacggagagaaaccacaactgtgggcaggtactattacgccatggactactggggccaggggaccacagtcaccgtgtcaagc

SEQ ID NO: 985 - protein, 8 aa, Artificial Sequence
  Description of Artificial Sequence: Synthetic peptide
GYAFSSYW

SEQ ID NO: 986 - DNA, 24 bp, Artificial Sequence
  Description of Artificial Sequence: Synthetic oligonucleotide
ggctatgccttttctagttactgg

SEQ ID NO: 987 - protein, 17 aa, Artificial Sequence
  Description of Artificial Sequence: Synthetic peptide
ARRETTTVGRYYYAMDY

SEQ ID NO: 988 - DNA, 51 bp, Artificial Sequence
  Description of Artificial Sequence: Synthetic oligonucleotide
gcacggagagaaaccacaactgtgggcaggtactattacgccatggactac

SEQ ID NO: 989 - protein, 8 aa, Artificial Sequence
  Description of Artificial Sequence: Synthetic peptide
IWPGDGDT

SEQ ID NO: 990 - DNA, 24 bp, Artificial Sequence
  Description of Artificial Sequence: Synthetic oligonucleotide
atttggcccggggatggagacaca

SEQ ID NO: 991 - protein, 110 aa, Artificial Sequence; identical to SEQ ID NO: 147
  Description of Artificial Sequence: Synthetic polypeptide

SEQ ID NO: 992 - DNA, 330 bp, Artificial Sequence
  Description of Artificial Sequence: Synthetic polynucleotide
gctcctgagctgctgggaggaccaagcgtgttcctgtttccacctaaacctaaggacactctgatgatctctcggactcccgaagtcacctgtgtggtcgtggatgtgagccacgaggaccctgaagtcaaattcaactggtacgtggatggcgtcgaggtgcataatgccaaaacaaagcctagggaggaacagtataactccacataccgcgtcgtgtctgtcctgactgtgctgcatcaggactggctgaacggaaaggagtacaaatgcaaggtgagcaacaaggccctgccagctcccatcgagaagaccatttccaaagctaag

SEQ ID NO: 993 - protein, 106 aa, Artificial Sequence; identical to SEQ ID NO: 21
  Description of Artificial Sequence: Synthetic polypeptide

SEQ ID NO: 994 - DNA, 318 bp, Artificial Sequence
  Description of Artificial Sequence: Synthetic polynucleotide
ggccagcctcgagaaccacaggtctatgtgctgccacccagccgggacgagctgacaaaaaaccaggtctccctgctgtgtctggtgaagggattctacccttctgatattgcagtggagtgggaaagtaatggccagccagaaaacaattatctgacttggcctccagtgctggattctgacgggagtttctttctgtacagtaaactgaccgtggataagtcacggtggcagcagggaaacgtctttagttgttcagtgatgcacgaggccctgcacaatcattacacccagaaaagcctgtccctgtctcccggc

SEQ ID NO: 995 - protein, 470 aa, Artificial Sequence
  Description of Artificial Sequence: Synthetic polypeptide
STAILALLLAVLQGVCSQVQLVQSGAEVKKPGASVKISCKASGYAFSSYWMNWVRQAPGQCLEWIGQIWPGDGDTNYAQKFQGRATLTADESTSTAYMELSSLRSEDTAVYYCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 996 - DNA, 1413 bp, Artificial Sequence
  Description of Artificial Sequence: Synthetic polynucleotide
atgggctccaccgctatcctggccctgctgctggctgtgctgcagggagtgtgctcccaggtgcaactggtccagagcggcgctgaggtgaagaagcctggcgcctccgtgaagatctcctgcaaggccagcggctacgccttctcctcctactggatgaactgggtgaggcaggctcctggccagtgcctggagtggattggccagatctggcccggagacggcgacaccaactacgcccagaagttccaaggacgggccaccctgaccgccgatgagtccacctccaccgcctacatggagctgtcctccctgaggtccgaggacaccgctgtgtactactgtgccaggagggagacaaccaccgtgggccggtactactacgccatggactactggggccagggcaccacagtcaccgtgtcctccgccagcaccaagggcccttccgtgttccctctggctccctcctccaagtccaccagcggaggcacagccgctctgggctgtctggtgaaggactacttccccgagcccgtgaccgtgagctggaactccggagccctgacctccggcgtgcataccttccccgccgtgctgcagtcctccggactgtactccctgtcctccgtggtgacagtgccctcctcctccctgggcacccagacctacatctgcaacgtgaaccacaagccctccaacaccaaggttgataagaaggtggagcccaagtcctgcgacaagacacacacctgccctccttgtcctgctcctgaggctgccggaggcccttccgtgttcctgttcccccccaagcccaaggacaccctgatgatcagcaggacccccgaggtgacctgcgtggtggtgtccgtgagccacgaggaccccgaggtgaagttcaactggtacgtggacggcgtggaggtgcacaacgctaagaccaagccccgggaggagcagtacaacagcacctacagggtggtgtccgtgctgaccgtgctgcaccaggactggctgaacggcaaggagtacaagtgcaaggtgtccaacaaggccctgcccgctcccatcgagaagaccatctccaaggccaagggccagcccagggaacctcaggtgtacgtgtaccccccctccagggacgagctgaccaagaaccaggtgtccctgacctgcctggtgaagggcttctacccctccgacatcgctgtggagtgggagtccaacggccagcccgagaacaactacaagaccacccctcccgtgctggacagcgacggatccttcgccctggtgtccaagctgaccgtggacaagtccaggtggcagcagggcaacgtgttctcctgctccgtgatgcacgaggccctgcacaaccactacacccagaagtccctgtccctgtccccc

SEQ ID NO: 997 - protein, 124 aa, Artificial Sequence; identical to SEQ ID NO: 575
  Description of Artificial Sequence: Synthetic polypeptide

SEQ ID NO: 998 - DNA, 372 bp, Artificial Sequence
  Description of Artificial Sequence: Synthetic polynucleotide
caggtgcaactggtccagagcggcgctgaggtgaagaagcctggcgcctccgtgaagatctcctgcaaggccagcggctacgccttctcctcctactggatgaactgggtgaggcaggctcctggccagtgcctggagtggattggccagatctggcccggagacggcgacaccaactacgcccagaagttccaaggacgggccaccctgaccgccgatgagtccacctccaccgcctacatggagctgtcctccctgaggtccgaggacaccgctgtgtactactgtgccaggagggagacaaccaccgtgggccggtactactacgccatggactactggggccagggcaccacagtcaccgtgtcctcc

SEQ ID NO: 999 - protein, 8 aa, Artificial Sequence
  Description of Artificial Sequence: Synthetic peptide
GYAFSSYW

SEQ ID NO: 1000 - DNA, 24 bp, Artificial Sequence
  Description of Artificial Sequence: Synthetic oligonucleotide
ggctacgccttctcctcctactgg

SEQ ID NO: 1001 - protein, 17 aa, Artificial Sequence
  Description of Artificial Sequence: Synthetic peptide
ARRETTTVGRYYYAMDY

SEQ ID NO: 1002 - DNA, 51 bp, Artificial Sequence
  Description of Artificial Sequence: Synthetic oligonucleotide
gccaggagggagacaaccaccgtgggccggtactactacgccatggactac

SEQ ID NO: 1003 - protein, 8 aa, Artificial Sequence
  Description of Artificial Sequence: Synthetic peptide
IWPGDGDT

SEQ ID NO: 1004 - DNA, 24 bp, Artificial Sequence
  Description of Artificial Sequence: Synthetic oligonucleotide
atctggcccggagacggcgacacc

SEQ ID NO: 1005 - protein, 98 aa, Artificial Sequence; identical to SEQ ID NO: 145
  Description of Artificial Sequence: Synthetic polypeptide

SEQ ID NO: 1006 - DNA, 294 bp, Artificial Sequence
  Description of Artificial Sequence: Synthetic polynucleotide
gccagcaccaagggcccttccgtgttccctctggctccctcctccaagtccaccagcggaggcacagccgctctgggctgtctggtgaaggactacttccccgagcccgtgaccgtgagctggaactccggagccctgacctccggcgtgcataccttccccgccgtgctgcagtcctccggactgtactccctgtcctccgtggtgacagtgccctcctcctccctgggcacccagacctacatctgcaacgtgaaccacaagccctccaacaccaaggttgataagaaggtg

SEQ ID NO: 1007 - protein, 110 aa, Artificial Sequence; identical to SEQ ID NO: 19
  Description of Artificial Sequence: Synthetic polypeptide

SEQ ID NO: 1008 - DNA, 330 bp, Artificial Sequence
  Description of Artificial Sequence: Synthetic polynucleotide
gctcctgaggctgccggaggcccttccgtgttcctgttcccccccaagcccaaggacaccctgatgatcagcaggacccccgaggtgacctgcgtggtggtgtccgtgagccacgaggaccccgaggtgaagttcaactggtacgtggacggcgtggaggtgcacaacgctaagaccaagccccgggaggagcagtacaacagcacctacagggtggtgtccgtgctgaccgtgctgcaccaggactggctgaacggcaaggagtacaagtgcaaggtgtccaacaaggccctgcccgctcccatcgagaagaccatctccaaggccaag

SEQ ID NO: 1009 - protein, 106 aa, Artificial Sequence; identical to SEQ ID NO: 89
  Description of Artificial Sequence: Synthetic polypeptide

SEQ ID NO: 1010 - DNA, 318 bp, Artificial Sequence
  Description of Artificial Sequence: Synthetic polynucleotide
ggccagcccagggaacctcaggtgtacgtgtaccccccctccagggacgagctgaccaagaaccaggtgtccctgacctgcctggtgaagggcttctacccctccgacatcgctgtggagtgggagtccaacggccagcccgagaacaactacaagaccacccctcccgtgctggacagcgacggatccttcgccctggtgtccaagctgaccgtggacaagtccaggtggcagcagggcaacgtgttctcctgctccgtgatgcacgaggccctgcacaaccactacacccagaagtccctgtccctgtcccccggc

SEQ ID NO: 1011 - protein, 493 aa, Artificial Sequence
  Description of Artificial Sequence: Synthetic polypeptide
FGLSWLFLVAILKGVQCQVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYYDDHYSLDYWGQGTLVTVSSVEGGSGGSGGSGGSGGVDDIQMTQSPSSLSASVGDRVTITCSASSSVSYMNWYQQKPGKAPKRLIYDTSKLASGVPSRFSGSGSGTDYTLTISSLQPEDAATYYCQQWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1012 - DNA, 1482 bp, Artificial Sequence
  Description of Artificial Sequence: Synthetic polynucleotide
atggagtttggcctgtcctggctgttcctggtcgctatcctgaagggcgtgcagtgccaagtgcagctggtgcagtccggaggaggagtggtgcagcctggacggagcctgaggctgtcctgcaaggcctccggatacaccttcacccggtacaccatgcattgggtgaggcaggctcctggcaagggcctggagtggatcggctacatcaatcccagccggggatacaccaactacaaccagaaagtgaagggccggttcaccatctccaccgacaacagcaagaacaccgcctatctgcagatggactccctgagggccgaggacaccggcgtgtacttttgcgctcggtactacgacgaccactattccctggactactggggccagggcacactggtgacagtctcctccgtggagggaggatccggaggaagcggaggcagcggaggatccggcggcgtggatgacatccagatgacccagtccccttcctccctgtccgcttccgtgggagacagggtgaccatcacctgctccgcctccagctccgtgtcctacatgaactggtaccagcaaaagcccggcaaggcccctaagcggctgatctacgacacaagcaagctggcttccggcgtgccttccaggttttccggcagcggctccggcacagactacaccctgaccatcagcagcctgcagcccgaggatgccgccacctactactgccagcagtggtccagcaaccctttcaccttcggccagggcaccaagctggagatcaaggccgctgagcccaagagctccgacaagacacacacctgccctccttgtcctgctcctgaggctgccggaggcccttccgtgttcctgttcccccccaagcccaaggacaccctgatgatcagcaggacccccgaggtgacctgcgtggtggtgtccgtgagccacgaggaccccgaggtgaagttcaactggtacgtggacggcgtggaggtgcacaacgctaagaccaagccccgggaggagcagtacaacagcacctacagggtggtgtccgtgctgaccgtgctgcaccaggactggctgaacggcaaggagtacaagtgcaaggtgtccaacaaggccctgcccgctcccatcgagaagaccatctccaaggccaagggccagcccagggaacctcaggtgtacgtgctgcccccctccagggacgagctgaccaagaaccaggtgtccctgctgtgcctggtgaagggcttctacccctccgacatcgctgtggagtgggagtccaacggccagcccgagaacaactacctgacctggccccctgtgctggattccgacggctccttcttcctgtactccaagctgaccgtggacaagtccaggtggcagcagggcaacgtgttctcctgctccgtgatgcacgaggccctgcacaaccactacacccagaagtccctgtccctgtccccc

SEQ ID NO: 1013 - protein, 119 aa, Artificial Sequence; identical to SEQ ID NO: 213
  Description of Artificial Sequence: Synthetic polypeptide

SEQ ID NO: 1014 - DNA, 357 bp, Artificial Sequence
  Description of Artificial Sequence: Synthetic polynucleotide
caagtgcagctggtgcagtccggaggaggagtggtgcagcctggacggagcctgaggctgtcctgcaaggcctccggatacaccttcacccggtacaccatgcattgggtgaggcaggctcctggcaagggcctggagtggatcggctacatcaatcccagccggggatacaccaactacaaccagaaagtgaagggccggttcaccatctccaccgacaacagcaagaacaccgcctatctgcagatggactccctgagggccgaggacaccggcgtgtacttttgcgctcggtactacgacgaccactattccctggactactggggccagggcacactggtgacagtctcctcc

SEQ ID NO: 1015 - protein, 8 aa, Artificial Sequence
  Description of Artificial Sequence: Synthetic peptide
GYTFTRYT

SEQ ID NO: 1016 - DNA, 24 bp, Artificial Sequence
  Description of Artificial Sequence: Synthetic oligonucleotide
ggatacaccttcacccggtacacc

SEQ ID NO: 1017 - protein, 12 aa, Artificial Sequence
  Description of Artificial Sequence: Synthetic peptide
ARYYDDHYSLDY

SEQ ID NO: 1018 - DNA, 36 bp, Artificial Sequence
  Description of Artificial Sequence: Synthetic oligonucleotide
gctcggtactacgacgaccactattccctggactac

SEQ ID NO: 1019 - protein, 8 aa, Artificial Sequence
  Description of Artificial Sequence: Synthetic peptide
INPSRGYT

SEQ ID NO: 1020 - DNA, 24 bp, Artificial Sequence
  Description of Artificial Sequence: Synthetic oligonucleotide
atcaatcccagccggggatacacc

SEQ ID NO: 1021 - protein, 106 aa, Artificial Sequence; identical to SEQ ID NO: 221
  Description of Artificial Sequence: Synthetic polypeptide

SEQ ID NO: 1022 - DNA, 318 bp, Artificial Sequence
  Description of Artificial Sequence: Synthetic polynucleotide
gacatccagatgacccagtccccttcctccctgtccgcttccgtgggagacagggtgaccatcacctgctccgcctccagctccgtgtcctacatgaactggtaccagcaaaagcccggcaaggcccctaagcggctgatctacgacacaagcaagctggcttccggcgtgccttccaggttttccggcagcggctccggcacagactacaccctgaccatcagcagcctgcagcccgaggatgccgccacctactactgccagcagtggtccagcaaccctttcaccttcggccagggcaccaagctggagatcaag

SEQ ID NO: 1023 - protein, 5 aa, Artificial Sequence
  Description of Artificial Sequence: Synthetic peptide
SSVSY

SEQ ID NO: 1024 - DNA, 15 bp, Artificial Sequence
  Description of Artificial Sequence: Synthetic oligonucleotide
agctccgtgtcctac

SEQ ID NO: 1025 - protein, 9 aa, Artificial Sequence
  Description of Artificial Sequence: Synthetic peptide
QQWSSNPFT

SEQ ID NO: 1026 - DNA, 27 bp, Artificial Sequence
  Description of Artificial Sequence: Synthetic oligonucleotide
cagcagtggtccagcaaccctttcacc

SEQ ID NO: 1027 - protein, 3 aa, Artificial Sequence
  Description of Artificial Sequence: Synthetic peptide
DTS

SEQ ID NO: 1028 - DNA, 9 bp, Artificial Sequence
  Description of Artificial Sequence: Synthetic oligonucleotide
gacacaagc

SEQ ID NO: 1029 - protein, 110 aa, Artificial Sequence; identical to SEQ ID NO: 19
  Description of Artificial Sequence: Synthetic polypeptide

SEQ ID NO: 1030 - DNA, 330 bp, Artificial Sequence; identical to SEQ ID NO: 1008
  Description of Artificial Sequence: Synthetic polynucleotide

SEQ ID NO: 1031 - protein, 106 aa, Artificial Sequence; identical to SEQ ID NO: 21
  Description of Artificial Sequence: Synthetic polypeptide

SEQ ID NO: 1032 - DNA, 318 bp, Artificial Sequence
  Description of Artificial Sequence: Synthetic polynucleotide
ggccagcccagggaacctcaggtgtacgtgctgcccccctccagggacgagctgaccaagaaccaggtgtccctgctgtgcctggtgaagggcttctacccctccgacatcgctgtggagtgggagtccaacggccagcccgagaacaactacctgacctggccccctgtgctggattccgacggctccttcttcctgtactccaagctgaccgtggacaagtccaggtggcagcagggcaacgtgttctcctgctccgtgatgcacgaggccctgcacaaccactacacccagaagtccctgtccctgtcccccggc

SEQ ID NO: 1033 - protein, 470 aa, Artificial Sequence
  Description of Artificial Sequence: Synthetic polypeptide
STAILALLLAVLQGVCSQVQLVQSGAEVKKPGASVKISCKASGYAFSSYWMNWVRQAPGQCLEWIGQIWPGDGDTNYAQKFQGRATLTADESTSTAYMELSSLRSEDTAVYYCARRETTTVGRYYYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 1034 - DNA, 1413 bp, Artificial Sequence
  Description of Artificial Sequence: Synthetic polynucleotide
atgggatccaccgctatcctggctctcctgctggctgtgctgcagggcgtgtgtagccaggtgcagctggtgcagagcggcgctgaagtgaagaagcccggcgcctccgtgaagatctcctgcaaggcctccggctacgcctttagctcctactggatgaactgggtcaggcaggctcccggccagtgtctcgagtggatcggccagatttggcctggcgatggcgacaccaactacgcccagaaattccagggcagggccaccctgaccgctgatgagtccacctccaccgcctacatggagctgtcctccctgcggtccgaggataccgccgtgtactactgcgcccggagggagaccaccaccgtgggcaggtactactacgccatggactactggggccagggcacaaccgtgaccgtgagctccgccagcaccaagggaccctccgtgtttcccctggctccctcctccaagtccacctccggaggcacagctgctctgggctgtctggtgaaggactattttcccgagcccgtgacagtgagctggaactccggcgccctgacatccggcgtgcacacattccctgccgtgctgcagtcctccggcctgtactccctgagctccgtggtgacagtgcccagcagcagcctgggcacccagacctacatctgcaacgtgaaccacaaaccctccaacacaaaggtggacaagaaggtggagcccaagtcctgtgacaagacacacacctgccctccttgtcctgctcctgaggctgccggaggcccttccgtgttcctgttcccccccaagcccaaggacaccctgatgatcagcaggacccccgaggtgacctgcgtggtggtgtccgtgagccacgaggaccccgaggtgaagttcaactggtacgtggacggcgtggaggtgcacaacgctaagaccaagccccgggaggagcagtacaacagcacctacagggtggtgtccgtgctgaccgtgctgcaccaggactggctgaacggcaaggagtacaagtgcaaggtgtccaacaaggccctgcccgctcccatcgagaagaccatctccaaggccaagggccagcccagggaacctcaggtgtacgtgctgcccccctccagggacgagctgaccaagaaccaggtgtccctgctgtgcctggtgaagggcttctacccctccgacatcgccgtggagtgggagtccaacggccagcctgagaacaactacctgacctggccccctgtgctggattccgacggctccttcttcctgtactccaagctgaccgtggacaagtccaggtggcagcagggcaacgtgttctcctgctccgtgatgcacgaggccctgcacaaccactacacccagaagtccctgtccctgtccccc

SEQ ID NO: 1035 - protein, 124 aa, Artificial Sequence; identical to SEQ ID NO: 575
  Description of Artificial Sequence: Synthetic polypeptide

SEQ ID NO: 1036 - DNA, 372 bp, Artificial Sequence
  Description of Artificial Sequence: Synthetic polynucleotide
caggtgcagctggtgcagagcggcgctgaagtgaagaagcccggcgcctccgtgaagatctcctgcaaggcctccggctacgcctttagctcctactggatgaactgggtcaggcaggctcccggccagtgtctcgagtggatcggccagatttggcctggcgatggcgacaccaactacgcccagaaattccagggcagggccaccctgaccgctgatgagtccacctccaccgcctacatggagctgtcctccctgcggtccgaggataccgccgtgtactactgcgcccggagggagaccaccaccgtgggcaggtactactacgccatggactactggggccagggcacaaccgtgaccgtgagctcc

SEQ ID NO: 1037 - protein, 8 aa, Artificial Sequence
  Description of Artificial Sequence: Synthetic peptide
GYAFSSYW

SEQ ID NO: 1038 - DNA, 24 bp, Artificial Sequence
  Description of Artificial Sequence: Synthetic oligonucleotide
ggctacgcctttagctcctactgg

SEQ ID NO: 1039 - protein, 17 aa, Artificial Sequence
  Description of Artificial Sequence: Synthetic peptide
ARRETTTVGRYYYAMDY

SEQ ID NO: 1040 - DNA, 51 bp, Artificial Sequence
  Description of Artificial Sequence: Synthetic oligonucleotide
gcccggagggagaccaccaccgtgggcaggtactactacgccatggactac

SEQ ID NO: 1041 - protein, 8 aa, Artificial Sequence
  Description of Artificial Sequence: Synthetic peptide
IWPGDGDT

SEQ ID NO: 1042 - DNA, 24 bp, Artificial Sequence
  Description of Artificial Sequence: Synthetic oligonucleotide
atttggcctggcgatggcgacacc

SEQ ID NO: 1043 - protein, 98 aa, Artificial Sequence; identical to SEQ ID NO: 145
  Description of Artificial Sequence: Synthetic polypeptide

SEQ ID NO: 1044 - DNA, 294 bp, Artificial Sequence
  Description of Artificial Sequence: Synthetic polynucleotide
gccagcaccaagggaccctccgtgtttcccctggctccctcctccaagtccacctccggaggcacagctgctctgggctgtctggtgaaggactattttcccgagcccgtgacagtgagctggaactccggcgccctgacatccggcgtgcacacattccctgccgtgctgcagtcctccggcctgtactccctgagctccgtggtgacagtgcccagcagcagcctgggcacccagacctacatctgcaacgtgaaccacaaaccctccaacacaaaggtggacaagaaggtg

SEQ ID NO: 1045 - protein, 110 aa, Artificial Sequence; identical to SEQ ID NO: 19
  Description of Artificial Sequence: Synthetic polypeptide

SEQ ID NO: 1046 - DNA, 330 bp, Artificial Sequence; identical to SEQ ID NO: 1008
  Description of Artificial Sequence: Synthetic polynucleotide

SEQ ID NO: 1047 - protein, 106 aa, Artificial Sequence; identical to SEQ ID NO: 21
  Description of Artificial Sequence: Synthetic polypeptide

SEQ ID NO: 1048 - DNA, 318 bp, Artificial Sequence
  Description of Artificial Sequence: Synthetic polynucleotide
ggccagcccagggaacctcaggtgtacgtgctgcccccctccagggacgagctgaccaagaaccaggtgtccctgctgtgcctggtgaagggcttctacccctccgacatcgccgtggagtgggagtccaacggccagcctgagaacaactacctgacctggccccctgtgctggattccgacggctccttcttcctgtactccaagctgaccgtggacaagtccaggtggcagcagggcaacgtgttctcctgctccgtgatgcacgaggccctgcacaaccactacacccagaagtccctgtccctgtcccccggc

SEQ ID NO: 1049 - protein, 493 aa, Artificial Sequence
  Description of Artificial Sequence: Synthetic polypeptide
FGLSWLFLVAILKGVQCQVQLVQSGGGVVQPGRSLRLSCKASGYTFTRYTMHWVRQAPGKGLEWIGYINPSRGYTNYNQKVKGRFTISTDNSKNTAYLQMDSLRAEDTGVYFCARYYDDHYSLDYWGQGTLVTVSSVEGGSGGSGGSGGSGGVDDIQMTQSPSSLSASVGDRVTITCSASSSVSYMNWYQQKPGKAPKRLIYDTSKLASGVPSRFSGSGSGTDYTLTISSLQPEDAATYYCQQWSSNPFTFGQGTKLEIKAAEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 1050 - DNA, 1482 bp, Artificial Sequence
  Description of Artificial Sequence: Synthetic polynucleotide
atggagtttggcctctcctggctgtttctggtggctatcctgaagggcgtgcagtgccaggtgcagctcgtgcagtccggaggaggcgtcgtgcaacctggcaggagcctgaggctgtcctgcaaggccagcggctacaccttcacccggtacaccatgcattgggtgaggcaggcccccggcaaaggcctggaatggatcggctacatcaacccctccaggggctacaccaactacaaccagaaggtgaagggccggttcaccatctccaccgacaactccaagaacacagcctacctgcagatggactccctgagggctgaagacacaggcgtgtatttctgcgccaggtactacgacgaccactactccctcgactactggggacagggcaccctggtgaccgtgtcctccgtggagggaggatccggaggatccggaggatccggaggctccggaggagtggacgacatccagatgacccagagccctagctccctgagcgcttccgtgggagaccgggtgacaatcacctgcagcgcctcctcctccgtgtcctacatgaactggtaccagcagaagcccggcaaggcccccaagaggctgatctacgacacatccaagctggcctccggagtgccctccaggtttagcggcagcggatccggcaccgactacaccctgaccatctcctccctgcagcccgaggatgccgctacctattactgccagcagtggtccagcaaccccttcaccttcggccagggcacaaagctggagatcaaggccgccgagcccaagtcctccgacaagacacacacctgccctccttgtcctgctcctgaggctgccggaggcccttccgtgttcctgttcccccccaagcccaaggacaccctgatgatcagcaggacccccgaggtgacctgcgtggtggtgtccgtgagccacgaggaccccgaggtgaagttcaactggtacgtggacggcgtggaggtgcacaacgctaagaccaagccccgggaggagcagtacaacagcacctacagggtggtgtccgtgctgaccgtgctgcaccaggactggctgaacggcaaggagtacaagtgcaaggtgtccaacaaggccctgcccgctcccatcgagaagaccatctccaaggccaagggccagcccagggaacctcaggtgtacgtgtaccccccctccagggacgagctgaccaagaaccaggtgtccctgacctgcctggtgaagggcttctacccctccgacatcgccgtggagtgggagtccaacggccagcctgagaacaactacaagaccacccctcctgtgctggactccgacggctccttcgccctggtgtccaagctgaccgtggacaagtccaggtggcagcagggcaacgtgttctcctgctccgtgatgcacgaggccctgcacaaccactacacccagaagtccctgtccctgtccccc

SEQ ID NO: 1051 - protein, 119 aa, Artificial Sequence; identical to SEQ ID NO: 213
  Description of Artificial Sequence: Synthetic polypeptide

SEQ ID NO: 1052 - DNA, 357 bp, Artificial Sequence
  Description of Artificial Sequence: Synthetic polynucleotide
caggtgcagctcgtgcagtccggaggaggcgtcgtgcaacctggcaggagcctgaggctgtcctgcaaggccagcggctacaccttcacccggtacaccatgcattgggtgaggcaggcccccggcaaaggcctggaatggatcggctacatcaacccctccaggggctacaccaactacaaccagaaggtgaagggccggttcaccatctccaccgacaactccaagaacacagcctacctgcagatggactccctgagggctgaagacacaggcgtgtatttctgcgccaggtactacgacgaccactactccctcgactactggggacagggcaccctggtgaccgtgtcctcc

SEQ ID NO: 1053 - protein, 8 aa, Artificial Sequence
  Description of Artificial Sequence: Synthetic peptide
GYTFTRYT

SEQ ID NO: 1054 - DNA, 24 bp, Artificial Sequence
  Description of Artificial Sequence: Synthetic oligonucleotide
ggctacaccttcacccggtacacc

SEQ ID NO: 1055 - protein, 12 aa, Artificial Sequence
  Description of Artificial Sequence: Synthetic peptide
ARYYDDHYSLDY

SEQ ID NO: 1056 - DNA, 36 bp, Artificial Sequence
  Description of Artificial Sequence: Synthetic oligonucleotide
gccaggtactacgacgaccactactccctcgactac

SEQ ID NO: 1057 - protein, 8 aa, Artificial Sequence
  Description of Artificial Sequence: Synthetic peptide
INPSRGYT

SEQ ID NO: 1058 - DNA, 24 bp, Artificial Sequence
  Description of Artificial Sequence: Synthetic oligonucleotide
atcaacccctccaggggctacacc

SEQ ID NO: 1059 - protein, 106 aa, Artificial Sequence; identical to SEQ ID NO: 221
  Description of Artificial Sequence: Synthetic polypeptide

SEQ ID NO: 1060 - DNA, 318 bp, Artificial Sequence
  Description of Artificial Sequence: Synthetic polynucleotide
gacatccagatgacccagagccctagctccctgagcgcttccgtgggagaccgggtgacaatcacctgcagcgcctcctcctccgtgtcctacatgaactggtaccagcagaagcccggcaaggcccccaagaggctgatctacgacacatccaagctggcctccggagtgccctccaggtttagcggcagcggatccggcaccgactacaccctgaccatctcctccctgcagcccgaggatgccgctacctattactgccagcagtggtccagcaaccccttcaccttcggccagggcacaaagctggagatcaag

SEQ ID NO: 1061 - protein, 5 aa, Artificial Sequence
  Description of Artificial Sequence: Synthetic peptide
SSVSY

SEQ ID NO: 1062 - DNA, 15 bp, Artificial Sequence
  Description of Artificial Sequence: Synthetic oligonucleotide
tcctccgtgtcctac

SEQ ID NO: 1063 - protein, 9 aa, Artificial Sequence
  Description of Artificial Sequence: Synthetic peptide
QQWSSNPFT

SEQ ID NO: 1064 - DNA, 27 bp, Artificial Sequence
  Description of Artificial Sequence: Synthetic oligonucleotide
cagcagtggtccagcaaccccttcacc

SEQ ID NO: 1065 - protein, 3 aa, Artificial Sequence
  Description of Artificial Sequence: Synthetic peptide
DTS

SEQ ID NO: 1066 - DNA, 9 bp, Artificial Sequence
  Description of Artificial Sequence: Synthetic oligonucleotide
gacacatcc

SEQ ID NO: 1067 - protein, 110 aa, Artificial Sequence; identical to SEQ ID NO: 19
  Description of Artificial Sequence: Synthetic polypeptide

SEQ ID NO: 1068 - DNA, 330 bp, Artificial Sequence; identical to SEQ ID NO: 1008
  Description of Artificial Sequence: Synthetic polynucleotide

SEQ ID NO: 1069 - protein, 106 aa, Artificial Sequence; identical to SEQ ID NO: 89
  Description of Artificial Sequence: Synthetic polypeptide

SEQ ID NO: 1070 - DNA, 318 bp, Artificial Sequence
  Description of Artificial Sequence: Synthetic polynucleotide
ggccagcccagggaacctcaggtgtacgtgtaccccccctccagggacgagctgaccaagaaccaggtgtccctgacctgcctggtgaagggcttctacccctccgacatcgccgtggagtgggagtccaacggccagcctgagaacaactacaagaccacccctcctgtgctggactccgacggctccttcgccctggtgtccaagctgaccgtggacaagtccaggtggcagcagggcaacgtgttctcctgctccgtgatgcacgaggccctgcacaaccactacacccagaagtccctgtccctgtcccccggc

SEQ ID NO: 1071 - protein, 218 aa, Artificial Sequence; identical to SEQ ID NO: 321
  Description of Artificial Sequence: Synthetic polypeptide

SEQ ID NO: 1072 - DNA, 651 bp, Artificial Sequence; identical to SEQ ID NO: 322
  Description of Artificial Sequence: Synthetic polynucleotide

SEQ ID NO: 1073 - protein, 111 aa, Artificial Sequence; identical to SEQ ID NO: 323
  Description of Artificial Sequence: Synthetic polypeptide

SEQ ID NO: 1074 - DNA, 333 bp, Artificial Sequence; identical to SEQ ID NO: 324
  Description of Artificial Sequence: Synthetic polynucleotide

SEQ ID NO: 1075 - protein, 10 aa, Artificial Sequence
  Description of Artificial Sequence: Synthetic peptide
QSVDYEGDSY

SEQ ID NO: 1076 - DNA, 30 bp, Artificial Sequence; identical to SEQ ID NO: 326
  Description of Artificial Sequence: Synthetic oligonucleotide

SEQ ID NO: 1077 - protein, 9 aa, Artificial Sequence
  Description of Artificial Sequence: Synthetic peptide
QQSTEDPWT

SEQ ID NO: 1078 - DNA, 27 bp, Artificial Sequence
  Description of Artificial Sequence: Synthetic oligonucleotide
cagcagagcaccgaggacccctggacc

SEQ ID NO: 1079 - protein, 3 aa, Artificial Sequence
  Description of Artificial Sequence: Synthetic peptide
DAS

SEQ ID NO: 1080 - DNA, 9 bp, Artificial Sequence
  Description of Artificial Sequence: Synthetic oligonucleotide
gacgcctcc

SEQ ID NO: 1081 - protein, 107 aa, Artificial Sequence [sequence omitted]

SEQ ID NO: 1082 - DNA, 321 bp, Artificial Sequence; identical to SEQ ID NO: 332
  Description of Artificial Sequence: Synthetic polynucleotide

SEQ ID NO: 1083 - protein, 50 aa, Artificial Sequence
  Description of Artificial Sequence: Synthetic polypeptide
  MISC_FEATURE (1)..(50): This sequence may encompass 1-10 "Gly-Gly-Gly-Gly-Ser" repeating units
GGGGSGGGGSGGGGSGGGGSGGGGSGGGGSGGGGSGGGGSGGGGSGGGGS

SEQ ID NO: 1084 - protein, 50 aa, Artificial Sequence
  Description of Artificial Sequence: Synthetic polypeptide
  MISC_FEATURE (1)..(50): This sequence may encompass 1-10 "Ser-Gly-Gly-Gly-Gly" repeating units
SGGGGSGGGGSGGGGSGGGGSGGGGSGGGGSGGGGSGGGGSGGGGSGGGG

SEQ ID NO: 1085 - protein, 54 aa, Artificial Sequence
  Description of Artificial Sequence: Synthetic polypeptide
  MISC_FEATURE (5)..(54): This region may encompass 1-10 "Ser-Gly-Gly-Gly-Gly" repeating units
GGGGSGGGGSGGGGSGGGGSGGGGSGGGGSGGGGSGGGGSGGGGSGGGGSGGGG

SEQ ID NO: 1086 - protein, 32 aa, Artificial Sequence
  Description of Artificial Sequence: Synthetic polypeptide
  MISC_FEATURE (3)..(32): This region may encompass 1-10 "Ser-Gly-Gly" repeating units
GGSGGSGGSGGSGGSGGSGGSGGSGGSGGSGG

SEQ ID NO: 1087 - protein, 15 aa, Artificial Sequence
  Description of Artificial Sequence: Synthetic peptide
GGGGSGGGGSGGGGS

SEQ ID NO: 1088 - protein, 20 aa, Artificial Sequence
  Description of Artificial Sequence: Synthetic peptide
SSTGGGGSGGGGSGGGGSDI

SEQ ID NO: 1089 - protein, 18 aa, Artificial Sequence
  Description of Artificial Sequence: Synthetic peptide
VEGGSGGSGGSGGSGGVD

SEQ ID NO: 1090 - protein, 20 aa, Artificial Sequence
  Description of Artificial Sequence: Synthetic peptide
GGGGSGGGGSGGGGSGGGGS

SEQ ID NO: 1091 - protein, 18 aa, Artificial Sequence
  Description of Artificial Sequence: Synthetic peptide
GSTSGGGSGGGSGGGGSS

SEQ ID NO: 1092 - protein, 18 aa, Artificial Sequence
  Description of Artificial Sequence: Synthetic peptide
GSTSGSGKPGSGEGSTKG

SEQ ID NO: 1093 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1094 - protein, 7 aa, Homo sapiens
RGSKPED

SEQ ID NO: 1095 - protein, 556 aa, Homo sapiens [sequence omitted]

SEQ ID NO: 1096 - protein, 217 aa, Homo sapiens
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1097 - protein, 15 aa, Artificial Sequence
  Description of Artificial Sequence: Synthetic peptide
EPKSCDKTHTCPPCP

SEQ ID NO: 1098 - DNA, 45 bp, Artificial Sequence
  Description of Artificial Sequence: Synthetic oligonucleotide
gagcccaagagctgtgataagacccacacctgccctccctgtcca

SEQ ID NO: 1099 - protein, 17 aa, Artificial Sequence
  Description of Artificial Sequence: Synthetic peptide
AAEPKSSDKTHTCPPCP

SEQ ID NO: 1100 - DNA, 51 bp, Artificial Sequence
  Description of Artificial Sequence: Synthetic oligonucleotide
gcagccgaacccaaatcctctgataagacccacacatgccctccatgtcca

SEQ ID NO: 1101 - protein, 15 aa, Artificial Sequence
  Description of Artificial Sequence: Synthetic peptide
EPKSSDKTHTCPPCP

SEQ ID NO: 1102 - DNA, 45 bp, Artificial Sequence
  Description of Artificial Sequence: Synthetic oligonucleotide
gagcctaaaagctccgacaagacccacacatgcccaccttgtccg

SEQ ID NO: 1103 - protein, 10 aa, Artificial Sequence
  Description of Artificial Sequence: Synthetic peptide
DKTHTCPPCP

SEQ ID NO: 1104 - DNA, 30 bp, Artificial Sequence
  Description of Artificial Sequence: Synthetic oligonucleotide
gacaagacccacacatgcccaccttgtccg

SEQ ID NO: 1105 - protein, 7 aa, Artificial Sequence
  Description of Artificial Sequence: Synthetic peptide
GTCPPCP

SEQ ID NO: 1106 - DNA, 21 bp, Artificial Sequence
  Description of Artificial Sequence: Synthetic oligonucleotide
ggcacatgccctccatgtcca

SEQ ID NO: 1107 - protein, 4 aa, Artificial Sequence
  Description of Artificial Sequence: Synthetic peptide
GFLG

SEQ ID NO: 1108 - protein, 4 aa, Artificial Sequence
  Description of Artificial Sequence: Synthetic peptide
ALAL

SEQ ID NO: 1109 - protein, 5 aa, Artificial Sequence
  Description of Artificial Sequence: Synthetic peptide
SSVSY

SEQ ID NO: 1110 - protein, 3 aa, Artificial Sequence
  Description of Artificial Sequence: Synthetic peptide
DTS

SEQ ID NO: 1111 - protein, 7 aa, Artificial Sequence
  Description of Artificial Sequence: Synthetic peptide
QQWSSNP

SEQ ID NO: 1112 - protein, 8 aa, Artificial Sequence
  Description of Artificial Sequence: Synthetic peptide
GYTFTRYT

SEQ ID NO: 1113 - protein, 8 aa, Artificial Sequence
  Description of Artificial Sequence: Synthetic peptide
INPSRGYT

SEQ ID NO: 1114 - protein, 12 aa, Artificial Sequence
  Description of Artificial Sequence: Synthetic peptide
ARYYDDHYCLDY

SEQ ID NO: 1115 - protein, 5 aa, Artificial Sequence
  Description of Artificial Sequence: Synthetic peptide
SSVSY

SEQ ID NO: 1116 - protein, 3 aa, Artificial Sequence
  Description of Artificial Sequence: Synthetic peptide
DTS

SEQ ID NO: 1117 - protein, 7 aa, Artificial Sequence
  Description of Artificial Sequence: Synthetic peptide
QQWSSNP

SEQ ID NO: 1118 - protein, 8 aa, Artificial Sequence
  Description of Artificial Sequence: Synthetic peptide
GYTFTRYT

SEQ ID NO: 1119 - protein, 8 aa, Artificial Sequence
  Description of Artificial Sequence: Synthetic peptide
INPSRGYT

SEQ ID NO: 1120 - protein, 12 aa, Artificial Sequence
  Description of Artificial Sequence: Synthetic peptide
ARYYDDHYSLDY

SEQ ID NO: 1121 - protein, 5 aa, Artificial Sequence
  Description of Artificial Sequence: Synthetic peptide
SSVSY

SEQ ID NO: 1122 - protein, 3 aa, Artificial Sequence
  Description of Artificial Sequence: Synthetic peptide
DTS

SEQ ID NO: 1123 - protein, 7 aa, Artificial Sequence
  Description of Artificial Sequence: Synthetic peptide
QQWSSNP

SEQ ID NO: 1124 - protein, 8 aa, Artificial Sequence
  Description of Artificial Sequence: Synthetic peptide
GYTFTRYT

SEQ ID NO: 1125 - protein, 8 aa, Artificial Sequence
  Description of Artificial Sequence: Synthetic peptide
INPSRGYT

SEQ ID NO: 1126 - protein, 12 aa, Artificial Sequence
  Description of Artificial Sequence: Synthetic peptide
ARYYDDHYSLDY

SEQ ID NO: 1127 - protein, 10 aa, Artificial Sequence
  Description of Artificial Sequence: Synthetic peptide
SASSSVSYMN

SEQ ID NO: 1128 - protein, 7 aa, Artificial Sequence
  Description of Artificial Sequence: Synthetic peptide
DTSKLAS

SEQ ID NO: 1129 - protein, 9 aa, Artificial Sequence
  Description of Artificial Sequence: Synthetic peptide
QQWSSNPFT

SEQ ID NO: 1130 - protein, 10 aa, Artificial Sequence
  Description of Artificial Sequence: Synthetic peptide
GYTFTRYTMH

SEQ ID NO: 1131 - protein, 10 aa, Artificial Sequence
  Description of Artificial Sequence: Synthetic peptide
YINPSRGYTN

SEQ ID NO: 1132 - protein, 10 aa, Artificial Sequence
  Description of Artificial Sequence: Synthetic peptide
YYDDHYSLDY

SEQ ID NO: 1133 - protein, 11 aa, Artificial Sequence
  Description of Artificial Sequence: Synthetic peptide
QSVDYDGDSYL

SEQ ID NO: 1134 - protein, 3 aa, Artificial Sequence
  Description of Artificial Sequence: Synthetic peptide
DAS

SEQ ID NO: 1135 - protein, 9 aa, Artificial Sequence
  Description of Artificial Sequence: Synthetic peptide
QQSTEDPWT

SEQ ID NO: 1136 - protein, 8 aa, Artificial Sequence
  Description of Artificial Sequence: Synthetic peptide
GYAFSSYW

SEQ ID NO: 1137 - protein, 8 aa, Artificial Sequence
  Description of Artificial Sequence: Synthetic peptide
IWPGDGDT

SEQ ID NO: 1138 - protein, 15 aa, Artificial Sequence
  Description of Artificial Sequence: Synthetic peptide
RETTTVGRYYYAMDY

SEQ ID NO: 1139 - protein, 11 aa, Artificial Sequence
  Description of Artificial Sequence: Synthetic peptide
QSVDYEGDSYL

SEQ ID NO: 1140 - protein, 3 aa, Artificial Sequence
  Description of Artificial Sequence: Synthetic peptide
DAS

SEQ ID NO: 1141 - protein, 9 aa, Artificial Sequence
  Description of Artificial Sequence: Synthetic peptide
QQSTEDPWT

SEQ ID NO: 1142 - protein, 8 aa, Artificial Sequence
  Description of Artificial Sequence: Synthetic peptide
GYAFSSYW

SEQ ID NO: 1143 - protein, 8 aa, Artificial Sequence
  Description of Artificial Sequence: Synthetic peptide
IWPGDGDT

SEQ ID NO: 1144 - protein, 15 aa, Artificial Sequence
  Description of Artificial Sequence: Synthetic peptide
RETTTVGRYYYAMDY

SEQ ID NO: 1145 - protein, 11 aa, Artificial Sequence
  Description of Artificial Sequence: Synthetic peptide
QSVDYSGDSYL

SEQ ID NO: 1146 - protein, 3 aa, Artificial Sequence
  Description of Artificial Sequence: Synthetic peptide
DAS

SEQ ID NO: 1147 - protein, 9 aa, Artificial Sequence
  Description of Artificial Sequence: Synthetic peptide
QQSTEDPWT

SEQ ID NO: 1148 - protein, 8 aa, Artificial Sequence
  Description of Artificial Sequence: Synthetic peptide
GYAFSSYW

SEQ ID NO: 1149 - protein, 8 aa, Artificial Sequence
  Description of Artificial Sequence: Synthetic peptide
IWPGDGDT

SEQ ID NO: 1150 - protein, 15 aa, Artificial Sequence
  Description of Artificial Sequence: Synthetic peptide
RETTTVGRYYYAMDY

SEQ ID NO: 1151 - protein, 14 aa, Artificial Sequence
  Description of Artificial Sequence: Synthetic peptide
KASQSVDYDGDSYL

SEQ ID NO: 1152 - protein, 7 aa, Artificial Sequence
  Description of Artificial Sequence: Synthetic peptide
DASNLVS

SEQ ID NO: 1153 - protein, 9 aa, Artificial Sequence
  Description of Artificial Sequence: Synthetic peptide
QQSTEDPWT

SEQ ID NO: 1154 - protein, 10 aa, Artificial Sequence
  Description of Artificial Sequence: Synthetic peptide
GYAFSSYWMN

SEQ ID NO: 1155 - protein, 10 aa, Artificial Sequence
  Description of Artificial Sequence: Synthetic peptide
QIWPGDGDTN

SEQ ID NO: 1156 - protein, 15 aa, Artificial Sequence
  Description of Artificial Sequence: Synthetic peptide
RETTTVGRYYYAMDY

SEQ ID NO: 1157 - protein, 14 aa, Artificial Sequence
  Description of Artificial Sequence: Synthetic peptide
RASQSVDYEGDSYL

SEQ ID NO: 1158 - protein, 7 aa, Artificial Sequence
  Description of Artificial Sequence: Synthetic peptide
DASNLVS

SEQ ID NO: 1159 - protein, 9 aa, Artificial Sequence
  Description of Artificial Sequence: Synthetic peptide
QQSTEDPWT

SEQ ID NO: 1160 - protein, 10 aa, Artificial Sequence
  Description of Artificial Sequence: Synthetic peptide
GYAFSSYWMN

SEQ ID NO: 1161 - protein, 10 aa, Artificial Sequence
  Description of Artificial Sequence: Synthetic peptide
QIWPGDGDTN

SEQ ID NO: 1162 - protein, 15 aa, Artificial Sequence
  Description of Artificial Sequence: Synthetic peptide
RETTTVGRYYYAMDY

SEQ ID NO: 1163 - protein, 14 aa, Artificial Sequence
  Description of Artificial Sequence: Synthetic peptide
RASQSVDYSGDSYL

SEQ ID NO: 1164 - protein, 7 aa, Artificial Sequence
  Description of Artificial Sequence: Synthetic peptide
DASNLVS

SEQ ID NO: 1165 - protein, 9 aa, Artificial Sequence
  Description of Artificial Sequence: Synthetic peptide
QQSTEDPWT

SEQ ID NO: 1166 - protein, 10 aa, Artificial Sequence
  Description of Artificial Sequence: Synthetic peptide
GYAFSSYWMN

SEQ ID NO: 1167 - protein, 10 aa, Artificial Sequence
  Description of Artificial Sequence: Synthetic peptide
QIWPGDGDTN

SEQ ID NO: 1168 - protein, 15 aa, Artificial Sequence
  Description of Artificial Sequence: Synthetic peptide
RETTTVGRYYYAMDY

SEQ ID NO: 1169 - protein, 111 aa, Mus sp.; identical to SEQ ID NO: 59

SEQ ID NO: 1170 - protein, 111 aa, Artificial Sequence
  Description of Artificial Sequence: Synthetic polypeptide
DIQLTQSPSSLSASVGDRATITCRASQSVDYDGDSYLNWYQQKPGKAPKLLIYDASNLVSGIPSRFSGSGSGTDFTLTISSVQPEDAATYYCQQSTEDPWTFGCGTKLEIK

SEQ ID NO: 1171 - protein, 111 aa, Artificial Sequence; identical to SEQ ID NO: 323
  Description of Artificial Sequence: Synthetic polypeptide

SEQ ID NO: 1172 - protein, 111 aa, Artificial Sequence
  Description of Artificial Sequence: Synthetic polypeptide
DIQLTQSPSSLSASVGDRATITCRASQSVDYSGDSYLNWYQQKPGKAPKLLIYDASNLVSGIPSRFSGSGSGTDFTLTISSVQPEDAATYYCQQSTEDPWTFGCGTKLEIK

SEQ ID NO: 1173 - protein, 124 aa, Mus sp.; identical to SEQ ID NO: 79

SEQ ID NO: 1174 - protein, 124 aa, Artificial Sequence
  Description of Artificial Sequence: Synthetic polypeptide
QVQLVQSGAEVKKPGASVKISCKASGYAFSSYWMNWVRQAPGQCLEWIGQIWPGDGDTNYAQKFQGRATLTADTSTSTAYMELSSLRSEDTAVYYCARRETTTVGRYYYAMDYWGQGTTVTVSS

SEQ ID NO: 1175 - protein, 124 aa, Artificial Sequence; identical to SEQ ID NO: 575
  Description of Artificial Sequence: Synthetic polypeptide

SEQ ID NO: 1176 - protein, 119 aa, Artificial Sequence [sequence omitted]

SEQ ID NO: 1177 - protein, 119 aa, Artificial Sequence [sequence omitted]

SEQ ID NO: 1178 - protein, 119 aa, Artificial Sequence; identical to SEQ ID NO: 501
  Description of Artificial Sequence: Synthetic polypeptide

SEQ ID NO: 1179 - protein, 119 aa, Artificial Sequence; identical to SEQ ID NO: 213
  Description of Artificial Sequence: Synthetic polypeptide

SEQ ID NO: 1180 - protein, 106 aa, Artificial Sequence
  Description of Artificial Sequence: Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQIK

SEQ ID NO: 1181 - protein, 106 aa, Artificial Sequence [sequence omitted]

SEQ ID NO: 1182 - protein, 106 aa, Artificial Sequence; identical to SEQ ID NO: 509
  Description of Artificial Sequence: Synthetic polypeptide

SEQ ID NO: 1183 - protein, 106 aa, Artificial Sequence; identical to SEQ ID NO: 221
  Description of Artificial Sequence: Synthetic polypeptide

What is claimed is:

1. A method of killing target cells that express a target antigen on the cell surface comprising:
contacting the target cells with an effective amount of a drug-conjugated antigen-binding construct in the presence of effector T cells, wherein the drug-conjugated antigen-binding construct comprises an antigen binding construct conjugated to mertansine (DM1) with a N-succinimidyl 4-(maleimidomethyl)cyclohexanecarboxylate (SMCC) linker and the antigen-binding polypeptide construct comprises a first antigen-binding polypeptide construct operably linked to a second antigen-binding polypeptide construct, wherein
the first antigen-binding polypeptide construct specifically binds a CD3 epsilon antigen expressed on the effector T cells and is an scFv and comprises a first heavy chain variable (VH) region comprising SEQ ID NO:213 and a first light chain variable (VL) region comprising SEQ ID NO:221; and
the second antigen-binding polypeptide construct comprising a second VH region comprising a CDR1, a CDR2, and a CDR3 and a second VL region comprising a CDR1, a CDR2, and a CDR3, wherein the second antigen binding polypeptide is an scFv or a Fab and specifically binds the target antigen and
the target antigen is CD19, and the second VH CDR1 comprises SEQ ID NO:591, the second VH CDR2 comprises SEQ ID NO:595, the second VH CDR3 comprises SEQ ID NO:593, the second VL CDR1 comprises SEQ ID NO:607, the second VL CDR2 comprises SEQ ID NO:611, and the second VL CDR3 comprises SEQ ID NO:609; or
the target antigen is CDH3, and the second VH CDR1 comprises SEQ ID NO:139, the second VH CDR2 comprises SEQ ID NO:143, the second VH CDR3 comprises SEQ ID NO:141, the second VL CDR1 comprises SEQ ID NO:683, the second VL CDR2 comprises SEQ ID NO:687, and the second VL CDR3 comprises SEQ ID NO:685; or
the target antigen is HER2, and the second VH CDR1 comprises SEQ ID NO:199, the second VH CDR2 comprises SEQ ID NO:203, the second VH CDR3 comprises SEQ ID NO:201, the second VL CDR1 comprises SEQ ID NO:823, the second VL CDR2 comprises SEQ ID NO:827, and the second VL CDR3 comprises SEQ ID NO:825; or
the target antigen is HER3 and the second VH CDR1 comprises SEQ ID NO:667, the second VH CDR2 comprises SEQ ID NO:671, the second VH CDR3 comprises SEQ ID NO:669, the second VL CDR1 comprises SEQ ID NO:795 the second VL CDR2 comprises SEQ ID NO:799, and the second VL CDR3 comprises SEQ ID NO:797; or
the target antigen is EGFR, and the second VH CDR1 comprises SEQ ID NO:651, the second VH CDR2 comprises SEQ ID NO:653, the second VH CDR3 comprises SEQ ID NO:655, the second VL CDR1 comprises SEQ ID NO:403, the second VL CDR2 comprises SEQ ID NO:407, and the second VL CDR3 comprises SEQ ID NO:405.

2. The method of claim 1, wherein the target cells that express the target antigen on the cell surface are in a subject, and wherein the method comprises administering to the subject an effective amount of the drug-conjugated antigen-binding construct.

3. The method of claim 1, wherein the second antigen-binding polypeptide is a Fab.

4. The method of claim 1, wherein the antigen-binding construct further comprises a scaffold operably linking the first and second antigen binding polypeptide constructs.

5. The method of claim 4, wherein the scaffold is a dimeric Fc.

6. The method of claim 5, wherein the dimeric Fc is a heterodimeric Fc comprising a first Fc polypeptide linked to the first antigen-binding polypeptide construct with or without a first linker and a second Fc polypeptide linked to the second antigen-binding polypeptide construct with or without a second linker.

7. The method of claim 6, wherein the first Fc polypeptide is linked to the first antigen-binding polypeptide construct with the first linker and the second Fc polypeptide is linked to the second antigen-binding polypeptide construct with the second linker and the first and second linkers are polypeptides comprising an IgG1 hinge region.

8. The method of claim 6, wherein the first Fc polypeptide comprises a first modified $CH_3$ domain comprising T350V_L351Y_F405A_Y407V and the second Fc polypeptide comprises a second modified $CH_3$ domain comprising T350V_T366L_K392L_T394W using EU numbering.

9. The method of claim 6, wherein both Fc polypeptides comprise $CH_2$ domains comprising the amino acid modifications L234A, L235A and D265S wherein the numbering is according to the EU numbering system.

10. The method of claim 1, wherein the drug to antigen-binding construct ratio (DAR) is in the range of 2 to 4.

11. The method of claim 2, wherein the subject is a human.

12. The method of claim 1, wherein the target antigen is CD19 and the second VH comprises SEQ ID NO:589 and the second VL comprises SEQ ID NO:605.

13. A method of killing target cells that express a target antigen on the cell surface, the method comprising contacting the target cells with an effective amount of a drug-conjugated antigen-binding construct in the presence of effector T cells, wherein the drug-conjugated antigen-binding construct comprises an antigen binding construct conjugated to mertansine (DM1) with a N-succinimidyl 4-(maleimidomethyl)cyclohexanecarboxylate (SMCC) linker and the antigen-binding polypeptide construct comprises a first antigen-binding polypeptide construct operably linked to a second antigen-binding polypeptide construct, wherein the first antigen-binding polypeptide construct specifically binds a CD3 epsilon antigen expressed on the effector T cells and is an scFv and comprises a first heavy chain variable (VH) region comprising SEQ ID NO:877 and a first light chain variable (VL) region comprising SEQ ID NO:885; and the second antigen-binding polypeptide construct specifically binds the target antigen expressed on the effector T cells and the target antigen is CDH3, and the second antigen-binding polypeptide construct is an scFv or a Fab and comprises a second heavy chain variable (VH) region comprising SEQ ID NO:137 and a second light chain variable (VL) region comprising SEQ ID NO:681.

14. The method of claim 1, wherein the target antigen is HER2 and the second VH comprises SEQ ID NO:197 and the second VL comprises SEQ ID NO:821.

15. The method of claim 1, wherein the target antigen is HER3 and the second VH comprises SEQ ID NO:665 and the second VL comprises SEQ ID NO:793.

* * * * *